(12) United States Patent
Landowski et al.

(10) Patent No.: US 10,240,159 B2
(45) Date of Patent: *Mar. 26, 2019

(54) PROTEASE DEFICIENT FILAMENTOUS FUNGAL CELLS AND METHODS OF USE THEREOF

(71) Applicant: Glykos Finland OY, Helsinki (FI)

(72) Inventors: Christopher Landowski, Helsinki (FI); Anne Huuskonen, Helsinki (FI); Juhani Saarinen, Helsinki (FI); Ann Westerholm-Parvinen, Kirkkonummi (FI); Anne Kanerva, Helsinki (FI); Jari Natunen, Vantaa (FI); Anna-Liisa Hanninen, Helsinki (FI); Noora Salovuori, Helsinki (FI); Merja Penttila, Helsinki (FI); Markku Saloheimo, Helsinki (FI)

(73) Assignee: Glykos Finland OY, Helsinki (FI)

( * ) Notice: Subject to any disclaimer, the term of this patent is extended or adjusted under 35 U.S.C. 154(b) by 186 days.

This patent is subject to a terminal disclaimer.

(21) Appl. No.: 15/375,635

(22) Filed: Dec. 12, 2016

(65) Prior Publication Data

US 2017/0275634 A1    Sep. 28, 2017

Related U.S. Application Data

(63) Continuation of application No. 14/370,255, filed as application No. PCT/EP2013/050126 on Jan. 4, 2013, now Pat. No. 9,567,596.

(60) Provisional application No. 61/583,559, filed on Jan. 5, 2012.

(51) Int. Cl.
| | |
|---|---|
| *C12N 15/80* | (2006.01) |
| *C07K 16/28* | (2006.01) |
| *C07K 16/00* | (2006.01) |
| *C07K 14/56* | (2006.01) |
| *C07K 14/61* | (2006.01) |
| *C07K 14/65* | (2006.01) |
| *C12P 21/02* | (2006.01) |
| *C12N 9/58* | (2006.01) |
| *C12P 21/00* | (2006.01) |

(52) U.S. Cl.
CPC .............. *C12N 15/80* (2013.01); *C07K 14/56* (2013.01); *C07K 14/61* (2013.01); *C07K 14/65* (2013.01); *C07K 16/00* (2013.01); *C07K 16/2887* (2013.01); *C12N 9/58* (2013.01); *C12P 21/005* (2013.01); *C12P 21/02* (2013.01); *C07K 2317/14* (2013.01); *C07K 2317/24* (2013.01); *C07K 2317/41* (2013.01); *C07K 2317/55* (2013.01); *C07K 2317/569* (2013.01); *C07K 2317/622* (2013.01); *C07K 2317/94* (2013.01); *Y02P 20/52* (2015.11)

(58) Field of Classification Search
None
See application file for complete search history.

(56) References Cited

U.S. PATENT DOCUMENTS

| | | |
|---|---|---|
| 4,758,512 A | 7/1988 | Goldberg et al. |
| 5,674,728 A | 10/1997 | Buxton et al. |
| 5,693,520 A | 12/1997 | Branner et al. |
| 5,756,338 A | 5/1998 | Buxton et al. |
| 5,776,730 A | 7/1998 | Stuart |
| 5,821,104 A | 10/1998 | Holm et al. |
| 5,840,570 A | 11/1998 | Berka et al. |
| 5,846,802 A | 12/1998 | Buxton et al. |
| 5,968,774 A | 10/1999 | Lehmbeck |
| 5,989,889 A | 11/1999 | Rey et al. |
| 6,013,452 A | 1/2000 | Christensen et al. |
| 6,013,489 A | 1/2000 | Musters et al. |
| 6,025,185 A | 2/2000 | Christensen et al. |
| 6,291,209 B1 | 9/2001 | Lehmbeck |
| 6,352,841 B1 | 3/2002 | Lehmbeck |
| 6,509,171 B1 | 1/2003 | Berka et al. |
| 6,806,062 B1 | 10/2004 | Hjort et al. |
| 7,122,330 B2 | 10/2006 | Emalfarb et al. |
| 7,163,804 B1 | 1/2007 | Royer et al. |
| 7,198,938 B2 | 4/2007 | Shuster et al. |
| 7,303,877 B2 | 12/2007 | Connelly et al. |
| 7,323,327 B2 | 1/2008 | Edens et al. |
| 7,691,621 B2 | 4/2010 | Wang |
| 7,771,971 B2 | 8/2010 | Connelly et al. |
| 7,794,974 B2 | 9/2010 | Peij et al. |
| 7,858,360 B2 | 12/2010 | Hansen et al. |
| 7,968,312 B2 | 6/2011 | Sagt et al. |
| 7,977,067 B2 | 7/2011 | Power et al. |
| 8,017,341 B2 | 9/2011 | Nikolaev et al. |
| 8,119,171 B2 | 2/2012 | Lopez et al. |
| 8,288,517 B2 | 10/2012 | Clarkson et al. |
| 8,389,269 B2 | 3/2013 | Sagt et al. |

(Continued)

FOREIGN PATENT DOCUMENTS

| | | |
|---|---|---|
| EP | 1 266 011 B1 | 5/2010 |
| WO | 1997/012045 A1 | 4/1997 |

(Continued)

OTHER PUBLICATIONS

Berka et al. Comparative genomic analysis of the thermophilic biomass-degrading fungi *Myceliophthora thermophila* and *Thielavia terrestris*. Nat Biotechnol. Oct. 2, 2011;29(10):922-7.

(Continued)

*Primary Examiner* — Manjunath N Rao
*Assistant Examiner* — Jae W Lee
(74) *Attorney, Agent, or Firm* — Patrick J. Halloran

(57) ABSTRACT

The present disclosure relates to compositions and methods useful for the production of heterologous proteins in filamentous fungal cells.

15 Claims, 58 Drawing Sheets

Specification includes a Sequence Listing.

(56) References Cited

U.S. PATENT DOCUMENTS

| | | | |
|---|---|---|---|
| 8,426,164 | B2 | 4/2013 | Hjort et al. |
| 8,450,098 | B2 | 5/2013 | Kim et al. |
| 8,633,010 | B2 | 1/2014 | Lehmbeck et al. |
| 8,647,856 | B2 | 2/2014 | Shasky et al. |
| 8,680,252 | B2 | 3/2014 | Emalfarb et al. |
| 8,716,004 | B2 | 5/2014 | Wang |
| 8,741,654 | B2 | 6/2014 | Bodie et al. |
| 8,812,247 | B2 | 8/2014 | Roubos et al. |
| 8,916,363 | B2 | 12/2014 | Gusakov et al. |
| 9,175,296 | B2 | 11/2015 | Punt et al. |
| 2004/0018573 | A1 | 1/2004 | Power et al. |
| 2008/0206816 | A1 | 8/2008 | Idiris et al. |
| 2009/0176219 | A1 | 7/2009 | Parenicova et al. |
| 2009/0221030 | A1 | 9/2009 | Bao et al. |
| 2009/0253173 | A1 | 10/2009 | Wang |
| 2009/0275079 | A1 | 11/2009 | Edens et al. |
| 2011/0111977 | A1 | 5/2011 | Retallack |
| 2011/0283422 | A1 | 11/2011 | Nelson et al. |
| 2011/0294191 | A1 | 12/2011 | Wang |
| 2012/0030839 | A1 | 2/2012 | Emalfarb et al. |
| 2012/0107856 | A1 | 5/2012 | Punt et al. |
| 2012/0149064 | A1 | 6/2012 | Wang et al. |
| 2012/0213728 | A1 | 8/2012 | Meehl et al. |
| 2012/0231502 | A1 | 9/2012 | Hamilton et al. |
| 2012/0232007 | A1 | 9/2012 | Bobrowicz et al. |
| 2012/0276075 | A1 | 11/2012 | Monod et al. |
| 2012/0288892 | A1 | 11/2012 | Maiyuran et al. |
| 2012/0328626 | A1 | 12/2012 | Sethuraman et al. |
| 2013/0011875 | A1 | 1/2013 | Meehl et al. |
| 2013/0084608 | A1 | 4/2013 | Szabo et al. |
| 2014/0212977 | A1 | 7/2014 | Yaver et al. |
| 2015/0337279 | A1 | 11/2015 | Zhang et al. |

FOREIGN PATENT DOCUMENTS

| | | | |
|---|---|---|---|
| WO | 1997/046689 | A1 | 12/1997 |
| WO | 2000/046375 | A2 | 8/2000 |
| WO | 2004/067709 | A2 | 8/2004 |
| WO | 2005/087922 | A1 | 9/2005 |
| WO | 2011075677 | A2 | 6/2011 |
| WO | 2012021883 | A2 | 2/2012 |
| WO | 2012024662 | A2 | 2/2012 |
| WO | 2012048334 | A2 | 4/2012 |
| WO | 2012061382 | A2 | 5/2012 |
| WO | 2013048661 | A2 | 4/2013 |

OTHER PUBLICATIONS

Berka et al. (2011) UniProt G2Q4X9.
Berka et al. (2011) UniProt G2Q6Z6.
Berka et al. (2011) UniProt G2Q8V1.
Berka et al. (2011) UniProt G2Q925.
Berka et al. (2011) UniProt G2QCB6.
Berka et al. (2011) UniProt G2QFE7.
Berka et al. (2011) UniProt G2QK78.
Martinez et. al (2008) UniProt G0RH05.
Martinez et. al (2008) UniProt G0RIW3.
Martinez et. al (2008) UniProt G0RRH0.
Martinez et. al (2008) UniProt G0RRK1.
Martinez et. al (2008) UniProt G0RVK0.
Fujinaga et al., "The Molecular Structure and Catalytic Mechanism of a Novel Carboxyl Peptidase from Scytalidium Lignicolum", Proc Natl Acad Sci U S A, vol. 101, No. 10, Mar. 9, 2004, pp. 3364-3369.
Idiris, et al. Enhanced productivity of protease-sensitive heterologous proteins by disruption of multiple protease genes in the fission yeast Schizosaccharomyces pombe. Appl. Microbiol. Biotech. 73: 404-420 (2006).
Idiris, et al. Construction of a protease-deficient strain set for the fission yeast Schizosaccharomyces pombe, useful for effective production of protease-sensitive heterologous proteins. Yeast, 23(1): 83-99 (2006).
Kataoka et al., "Catalytic residues and substrate specificity of scytalidoglutamic peptidase, the first member of the eqolisin in family (G1) of peptidases", FEBS Letters, 579(14), Jun. 6, 2005, pp. 2991-2994.
Kubicek, et al. Comparative genome sequence analysis underscores mycoparasitism as the ancestral life style of Trichoderma. Genome Biol. 12:R40.1-R40.15 (2011).
Oda, K. Scytalidopepsin B. Handbook of Proteolytic Enzymes, 2nd Ed. (2004).
Rolland, et al. pH controls both transcription and post-translational processing of the protease BcACP1 in the phytopathogenic fungus Botrytis cinerea. Microbiol. 155: 2097-2105 (2009).
Takahashi, K. Aspergillopepsin II. Handbook of Proteolytic Enzymes, 2nd Ed. (2004).
Yabuki, et al. Identification of a glutamine residue essential for catalytic activity of asperfilloglutamic peptidase by site-directed mutagenesis. FEBS Letter, 569: 161-4 (2004).
Kubicek, et al. Uniprot G9MUE5, XP_013956131 (Feb. 22, 2012).
Kubicek, et al. Uniprot G9NC88, XP_013949516 (Feb. 22, 2012).
Kubicek, et al. Uniprot G9NQ54, XP_013945396 (Feb. 22, 2012).
Kubicek, et al. Uniprot G9P711, XP_013939835 (Feb. 22, 2012).
Martinez, et al. Uniprot G0R9K1, XP_006961397 (Oct. 19, 2011).
Kubicek, et al. UniProt G9ML58 (2012).
Kubicek, et al. UniProt G9MS93 (2012).
Kubicek, et al. UniProt G9P169 (2012).
Kubicek, et al. UniProt G9NTY0 (2012).
Kubicek, et al. UniProt G9MY25 (2012).
Kubicek, et al. UniProt G9NLJ5 (2012).
Long, et al. UniProt I2EC22 (2012).
Suarez, et al. UniProt A4V8W6 (2007).
Viterbo, et al. UniProt Q64HW0 (2004).
Roberts et al., "Heterologous Gene Expression in Aspergillus Niger: a Glucoamylase-Porcine Pancreatic Prophospholipase A2 Fusion Protein is Secreted and Processed to Yield Mature Enzyme", Gene., 122, 1992, pp. 155-161.
Sharma et al., "Approaches for Refining Heterologous Protein Production in Filamentous Fungi", World J Microbiol Biotechnol, 25, 2009, pp. 2083-2094.
Sharon et al., "Transcription Factor PrtT Controls Expression of Multiple Secreted Proteases in the Human Pathogenic Mold Aspergillus fumigatus", Infection and Immunity, vol. 77, No. 9, Sep. 2009, pp. 4051-4060.
Simkovic et al., "Induction of Secretion of Extracellular Proteases from Trichoderma Viride", Acta Chimica Slovaca, vol. 1, No. 1, 2008, pp. 250-264.
Sims et al., "Glutamic Protease Distribution is Limited to Filamentous Fungi", FEMS Microbiology Letters, 239, 2004, pp. 95-101.
Sriranganadane et al., "Secreted Glutamic Protease Rescues Aspartic Protease Pep Deficiency in Aspergillus Fumigatus During Growth in Acidic Protein Medium", Microbiology, 157, 2011, pp. 1541-1550.
Suárez et al., "Characterization of Genes Encoding Novel Peptidases in the Biocontrol Fungus Trichoderma harzianum CECT 2413 Using the TrichoEST Functional Genomics Approach", Curr Genet, 51, 2007, pp. 331-342.
Uusitalo et al., Enzyme Production by Recombinant Trichoderma Reesei Strains. Journal of Biotechnology, 17, 1991, pp. 35-50.
Van Den Hombergh et al., "New Protease Mutants in Aspergillus Niger Result in Strongly Reduced in Vitro Degradation of Target Proteins; Genetical and Biochemical Characterization of Seven Complementation Groups", Curr Genet, 28, 1995, pp. 299-308.
Van Den Hombergh et al., "Improve the Efficiency of Protein Expression in Fungi", Chemtech 26, Feb. 1996, pp. 30-37.
Van Den Hombergh et al., "Aspergillus as a Host for Heterologous Protein Production: The Problem of Proteases", Tibtech, vol. 15, Jul. 1997, pp. 256-263.
Van Den Hombergh et al., "Production of the Homologous Pectin Lyase B Protein in Six Genetically Defined Protease-Deficient Aspergillus Niger Mutant Stains", Curr Genet, vol. 32, Jul. 1997, pp. 73-81.
Van Kuyk et al.. "Analysis of Two Aspergillus Nidulans Genes Encoding Extracellular Proteases", Fungal Genetics and Biology, vol. 29, Apr. 2000, pp. 201-210.

(56) References Cited

OTHER PUBLICATIONS

Vázquez-Laslop et al., "Characterization of a Vacuolar Protease in Neurospora Crassa and the Use of Gene Riping to Generate Protease-Deficient Strains", The Journal of Biological Chemistry, vol. 271, No. 36, Sep. 1996, pp. 21944-21949.

Vinterová et al., "Evidence for the Presence of Proteolytically Active Secreted Aspartic Proteinase of Candida Parapsilosis in the Cell Wall", Protein Science, vol. 20, Dec. 2011, pp. 2004-2012.

Wang et al., "Bioprocessing Strategies to Improve Heterologous Protein Production in Filamentous Fungal Fermentations", Biotechnology Advances, vol. 23, Mar. 2005, pp. 115-129.

Wang et al., "Isolation of Four Pepsin-Like Protease Genes from Aspergillus Niger and Analysis of the Effect of Disruptions on Heterologous Laccase Expression", Fungal Genetics and Biology, vol. 45, Jan. 2008, pp. 17-27.

Xu et al., "Increased Heterologous Protein Production in Aspergillus Niger Fermentation through Extracellular Proteases Inhibition by Pelleted Growth", Biotechnol Prog., vol. 16, No. 2, Mar.-Apr. 2000, pp. 222-227.

Yan et al., "Cloning and Heterologous Expression of SS10, A Subtilisin-Like Protease Displaying Antifungal Activity from Trichoderma Harzianum", FEMS Microbiology Letters, vol. 290, Jan. 2009, pp. 54-61.

Zhu et al., "Improved Heterologous Protein Production by a Tripeptidyl Peptidase Gene (Aosedd) Disruptant of the Filamentous Fungus *Aspergillus oryzae*", The Journal of General and Applied Microbiology, vol. 58, 2012, pp. 199-209.

Zhu et al., "Further Enhanced Production of Heterologous Proteins by Double-Gene Disruption (ΔAosedD ΔAovps10) in a Hyper-Producing Mutant of Aspergillus Oryzae", Applied Microbiology and Biotechnology, vol. 97, 2013, pp. 6347-6357.

Adav et al., "Proteomic Analysis of pH and Strains Dependent Protein Secretion of Trichoderma Reesei", J Proteome Res., (10)10, Oct. 7, 2011, pp. 4579-4596.

Archer et al., "Proteolytic Degradation of Heterologous Proteins Expressed in Aspergillus Niger", Biotechnology Letters, vol. 14, Issue 5, May 5, 1992, pp. 357-362.

Behnsen et al., "Secreted Aspergillus Fumigatus Protease Alp1 Degrades Human Complement Proteins C3, C4, and C5", Infect Immun., 78(B), Aug. 2010, pp. 3585-3594.

Berka et al., "Molecular Cloning and Deletion of the Gene Encoding Aspergillopepsin a from Aspergillus Awamori", Gene., 86(2), Feb. 14, 1990, pp. 153-162.

Broekhuijsen et al., "Secretion of Heterologous Proteins by Aspergillus Niger: Production of Active Human Interleukin-6 in a Protease-Deficient Mutant by KEX2-like Processing of a Glucoamylase-hIL6 Fusion Protein", Journal of Biotechnology, 31(2), Nov. 1993, pp. 135-145.

Dal Degan et al., "Purification and Characterization of two Serine Carboxypeptidases from Aspergillus Niger and their use in C-terminal Sequencing of Proteins and Peptide Synthesis", Applied and Environment Microbiology, 58(7), Jul. 1992, pp. 2144-2152.

Delgado-Jarana et al., "Overproduction of Beta-1,6-glucanase in Trichoderma Harzianum is Controlled by Extracellular Acidic Proteases and pH", Biochimca et Biophysica Acta, 1481(2), Sep. 29. 2000, pp. 289-296.

Delgado-Jarana et al., "Aspartyl Protease from Trichoderma Harzianum CECT 2413: Cloning and Characterization" Microbiology, 148(Pt 5), May 2002, pp. 1305-1315.

Diener et al., "Characterization of the Protein Processing and Secretion Pathways in a Comprehensive Set of Expressed Sequence Tags from Trichoderma reesei", FEMS Microbiology Letters, 230(2), Jan. 30, 2004, pp. 275-282.

Dienes et al., "Identification of a trypsin-like Serine Protease from Trichoderma reesei QM9414", Enzyme and Microbial Technology, vol. 40, Issue 5, Apr. 3, 2007, pp. 1087-1094.

Durand-Poussereau et al., "Characterization of a Protease Deficient Strain of Penicillium Roqueforti Generated by Heterologous Plasmid Integration: Potential use for Protein Production", Journal of Biotechnology, 51(1), Oct. 18, 1996, pp. 97-105.

Edens et al.,"Extracellular Prolyl Endoprotease from Aspergillus Niger and its use in the Debittering of Protein Hydrolysates", Journal of Agricultural and Food Chemistry, 53(20), Oct. 5, 2005, pp. 7950-7957.

Eneyskaya et al., "Acid protease from Trichoderma reesei: Limited Proteolysis of Fungal Carbohydrases", Applied Microbiology and Biotechnology, vol. 52, Issue 52, Aug. 1999, pp. 226-231.

Foreman et al., "Transcriptional Regulation of Biomass-degrading Enzymes in the Filamentous Fungus *Trichoderma reesei*", Journal of Biological Chemistry, vol. 278, No. 34, Aug. 22, 2003, pp. 31988-31997.

Frenken et al., "Recent Advances in the Large-scale Production of Antibody Fragments using Lower Eukaryotic Microorganisms", Research in Immunology, vol. 149, Issue 6, Jul. 1998, pp. 589-599.

Gagnon-Arsenault et al., "Fungal Yapsins and Cell Wall: a Unique Family of Aspartic Peptidases for a Distinctive Cellular Function", FEMS Yeast Research, 6(7), Nov. 2006, pp. 966-978.

Gouka et al., "Efficient Production of Secreted Proteins by Aspergillus: Progress, Limitations and Prospects", Applied Microbiology and Biotechnology, vol. 47, Issue 1, Jan. 1997, pp. 1-11.

Haab et al., "Formation of the Extracellular Proteases from Trichoderma reesei QM 9414 Involved in Cellulase Degradation", Journal of Biotechnology, vol. 16, Issue 3-4, Nov. 1990, pp. 187-198.

Hagspiel et al., "Protease Activity and Proteolytic Modification of cellulases from a Trichoderma reesei QM 9414 seleclant", Applied Microbiology and Biotechnology, vol. 32, Issue 1, Nov. 1989, pp. 61-67.

Huang et al., "Identification of a Glutamic Acid and an Aspartic Acid Residue Essential for Catalytic Activity of Aspergillopepsin II, a non-pepsin type Acid Proteinase", The Journal of Biological Chemistry, vol. 275, No. 34, Aug. 25, 2000, pp. 26607-26614.

Inoue et al., "The Gene and Deduced Protein Sequences of the Zymogen of Aspergillus Niger acid Proteinase A", The Journal of Biological Chemistry, vol. 266, No. 29, Oct. 15, 1991, pp. 19484-19489.

Janas, "Production of Extracellular Enzymes by Low-protease Mutants of Trichoderma reesei", Technologia Alimentaria, Issue 2(2), 2003, pp. 103-114.

Jarai et al., "Cloning and Characterization of the pepE Gene of Aspergillus Niger Encoding a new Aspartic Protease and Regulation of pepE and pepC", Gene., 145(2), Aug. 1994, pp. 171-178.

Jin et al., "Double Disruption of the Proteinase Genes, tppA and pepE, Increases the Production Level of Human Lysozyme by Aspergillus Oryzae", Applied Microbiology and Biotechnology, vol. 76, Issue 5, Oct. 2007, pp. 1059-1068.

Kakimori et al., "Nucleotide Sequence of the Gene Encoding Pepstatin-insensitive Acid Protease B, Scytalidopepsin B, of Scytalidium Lignicolum", Bioscience Biotechnology and Biochemistry, 60(7), 1996, pp. 1210-1211.

Kimura et al., "Monitoring Global Gene Expression of Proteases and Improvement of Human Lysozyme Production in the nptB gene disruptant of Aspergillus oryzae" Bioscience, Biotechnology, and Biochemistry, vol. 72, Issue 2, Feb. 2008, pp. 499-505.

Kruszewska, "Heterologous expression of genes in filamentous fungi", Acta Biochimica Polonica, vol. 46. No. 1, 1999, 181-195.

Liu et al., "A new Serine Protease Gene from Trichoderma Harzianum is Expressed in *Saccharomyces cerevisiae*", Prikl Biokhim Mikrobiol., 45(1), Jan.-Feb. 2009, pp. 28-32.

Lu et al., "Molecular Cloning of a cDNA for Proctase B from *Aspergillus niger* var. *macrosporus* and Sequence Comparison with Other Aspergillopepsins I", Bioscience, Biotechnology, and Biochemistry, 59(5), 1995, pp. 954-955.

Lubertozzi et al., "Developing Aspergillus as a Host for Heterologous Expression", Biotechnology Advances, 27(1), Jan.-Feb. 2009, pp. 53-75.

Maita et al., "Complete Amino Acid Sequence of Scytalidium Lignicolum Acid Protease B", Journal of Biochemistry, 95(2), Feb. 1984, pp. 465-475.

Margolles-Clark et al., "Improved Production of Trichoderma Harzianum Endochitinase by Expression in Trichoderma Reesei", Applied and Environmental Microbiology, vol. 2, No. 6, Jun. 1996, pp. 2145-2151.

(56) References Cited

OTHER PUBLICATIONS

Maruyama et al., "Multiple Gene Disruptions by Marker Recycling with Highly Efficient Gene-Targeting Background (DeltaligD) in Aspergillus Oryzae", Biotechnol Letters, vol. 30, Issue 10, Oct. 2008, pp. 1811-1817.
Mattern et al., "Isolation and Characterization of Mutants of Aspergillus Niger Deficient in Extracellular Proteases", Molecular and General Genetics MGG, vol. 234, Issue 2, Aug. 1992, pp. 332-336.
Moralejo et al., "Thaumatin Production in Aspergillus Awamori by Use of Expression Cassettes with Strong Fungal Promoters and High Gene Dosage", Applied and Environmental Microbiology, vol. 65 No. 3, Mar. 1999, pp. 1168-1174.
Moralejo et al., "Overexpression and Lack of Degradation of Thaumatin in an Aspergillopepsin A-Defective Mutant of Aspergillus Awamori Containing an Insertion in the pepA gene", Applied Microbiology and Biotechnology, vol. 54, Issue 6, Dec. 2000, pp. 772-777.
Moralejo et al., "Silencing of the Aspergillopepsin B (pepB) Gene of Aspergillus Awamori by Antisense RNA Expression or Protease Removal by Gene Disruption Results in a Large Increase in Thaumatin Production", Applied and Environmental Microbiology, vol. 68, No. 7, Jul. 2002, pp. 3550-3559.
Morya et al., "In Silico Characterization of Alkaline Proteases from Different Species of Aspergillus", Applied Biochemistry and Biotechnology, vol. 166, Issue 1, Jan. 2012, pp. 243-257.
Mäntylä et al., "Industrial mutants and recombinant strains of Trichoderma reesei", In: Trichoderma and Gliocladium, vol. 2, 1998, pp. 291-309.
Nascimento et al., "Statistical Coupling Analysis of Aspartic Proteinases Based on Crystal Structures of the Trichoderma Reesei Enzyme and its Complex with Pepstatin A", Journal of Molecular Biology, vol. 382, Issue 3, Oct. 10, 2008, pp. 763-778.
Nemoto et al.. "Isolation of Aspergillus Oryzae Mutants for Heterologous Protein Production from a Double Proteinase Gene Disruptant" Applied Microbiology and Biotechnology, vol. 82, Issue 6, Apr. 2009, pp. 1105-1114.
Oda et al., "Nucleotide Sequence of the Gene Encoding the Precursor Protein of Pepstatin Insensitive Acid Protease B, Scytalidopepsin B, from Scytalidium Lignicolum", Bioscience, Biotechnology, and Biochemistry, 62(8), Aug. 1998, pp. 1637-1639.
O'Donoghue et al., "Inhibition of a Secreted Glutamic Peptidase Prevents Growth of the Fungus Talaromyces Emersonii", Journal of Biological Chemistry, vol. 283. No. 43, Oct. 24, 2008, pp. 29186-29195.
Pillai et al., "Crystal Structure of Scytalidoglutamic Peptidase with its First Potent Inhibitor Provides Insights into Substrate Specificity and Catalysis", Journal of Molecular Biology, vol. 365, Issue 2, 2007, pp. 343-361.

Pozo et al., "Functional Analysis of tvsp1, a Serine Protease-Encoding Gene in the Biocontrol Agent Trichoderma Virens", Fungal Genetics and Biology, 41, 2004, pp. 336-348.
Reichard et al., "Molecular Cloning and Sequencing of the Gene Encoding an Extracellular Aspartic Proteinase from Aspergillus Fumigatus", FEMS Microbioly Letters, 130, 1995, pp. 69-74.
Reichard et al., "Molecular Cloning and Targeted Deletion of PEP2 Which Encodes a Novel Aspartic Proteinase from Aspergillus Fumigatus", Int. J. Med. Microbiol., 290, 2000, pp. 85-96.
Reichard et al., "Sedolisins, a New Class of Secreted Proteases from Aspergillus Fumigatus with Endoprotease or Tripeptidyl-Peptidase Activity at acidic pHs", Applied and Environmental Microbiology, vol. 72, No. 3, Mar. 2006, pp. 1739-1748.
Ahamed, et al. Chymostatin can combine with pepstatin to eliminate extracellular protease activity in cultures of Aspergillus niger NRRL-3. J. Ind. Microbiol. Biotechnol. 34: 165-169 (2007).
Baldwin, et al. Develop Systems for Manufacturing 100,000,000 Doses of an Emergency Pharmaceutical (e.g. Vaccine or Monoclonal Antibody) Within 2 Months of Product Identification, Genencor International (Jun. 6, 2009).
Hintz et al., Improved gene expression in Aspergillus nidulans. Can. Jo. Bot 73 (Supp. 1): S876-S884 (1995).
Idiris, et al. Enhanced protein secretion from multiprotease-deficient fission yeast by modification of its vacuolar protein sorting pathway. Appl. Microbiol. Biotechnol. 85: 667-677 (2010).
Krysan, et al. Yapsins are a family of aspartyl proteases required for cell wall integrity in *Saccharomyces cerevisiae*. Eukaryotic Cell. 4(8): 1364-1374 (2005).
Kuroda, et al. Antibody expression in protease-deficient strains of the methlotrophic yeast *Ogataea minuta*. FEMS Yeast Res. 7: 1307-1316 (2007).
Martinez, et al. Genome sequencing and analysis of the biomass-degrading fungus *Trichoderma reesei* (syn. *Hypocrea jecorina*). Nature Biotech. 26(5): 553-560 (2008).
Martinez, et al. Uniprot GORG34, XP002712642 (Oct. 19, 2011).
Martinez, et al. Uniprot GORIW3, XP002712643 (Oct. 19, 2011).
Martinez, et al. Uniprot GORHO5, XP002712644 (Oct. 19, 2011).
Martinez, et al. Uniprot GORSP8, XP002712645 (Oct. 19, 2011).
Martinez, et al. Uniprot GORVKO, XP002712646 (Oct. 19, 2011).
Martinez, et al. Uniprot GOR8TO, XP002712647 (Oct. 19, 2011).
Van Den Hobergh, et al. Disruption of three acid proteases in Aspergillus niger. Eur. J. Biochem. 247: 605-613 (1997).
Yoon, et al. Construction of quintuple protease gene disruptant for heterologous protein production in aspergillus oryzae. Appl. Microbiol. Biotechnol. 82: 691-701 (2009).
Yoon, et al. Disruption of ten protease genes in the filamentous fungus *Aspergillus oryzae* highly improves production of heterologous proteins. Appl. Microbiol. Biotechnol. (Oct. 19, 2010).
Mäntylä et al. Cloning of the aspartic protease gene of *Trichoderma reesei*.Proc. Second Eur. Conf. on Fungal Genetics, Apr. 29-May 1, 1994, Book of Abstracts (1994).

pH 5.5
MAB01 heavy chain pH 4.5
MAB01 heavy chain pH 4.5
native IGF1

MAB01 heavy chain

MAB01 light chain

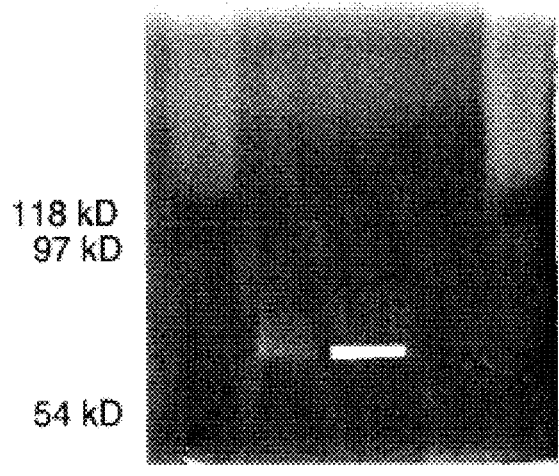
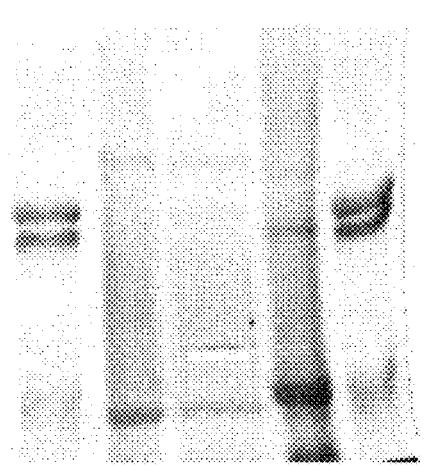
FIGURE 21A
FIGURE 21B

Rituximab heavy chain

MAB01 heavy chain

*slp1* ORF probe

5' probe

3' probe gap1 ORF probe gap1 5' probe gap1 3' probe

GAP2 ORF probe

5' flank probe

3' flank probe

Δpep1 improves heavy chain stability 2 mg/ml large shake flask supernatant (Δpep1 and M124); 2 mg/ml fed batch fermentation supernatant; 18 hour incubation at 37°C at pH 5.5

2 mg/ml large shake flask supernatant (Δpep1 and M124); 2 mg/ml fed batch fermentation supernatant; 18 hour incubation at 37°C at pH 5.5

Δtsp1 improves the rituximab heavy chain production levels on day 5.

Lanes: 1) 50 ng Rx control, 2 & 3) parental strain Rx 25A
Δtsp1 4) 12-2A, 5) 12-16A, 6) 12-19A, 7) 12-20A, 8) 12-34A transformants in lane 4 and 5, clearly show more heavy chain than in lane 2 and 3.

MAB01 heavy chain degradation is reduced in triple deletion strain supernatant M277

Day 5 supernatants

Day 7 supernatants 2.5-fold more heavy chain on day 5

4-fold more heavy chain on day 7

Supernatants diluted to 6 mg/ml, spiked with MAB01 0.05 µg/µl, and incubated at 37°C. M277 is Δpep1 Δtsp1 Δslp1; M124 is full protease containing control strain.

PROTEASE DEFICIENT FILAMENTOUS FUNGAL CELLS AND METHODS OF USE THEREOF

CROSS-REFERENCE TO RELATED APPLICATIONS

This application is a continuation application of U.S. Ser. No. 14/370,255 filed Jul. 2, 2014, now U.S. Pat. No. 9,567,596, which was filed under 35 U.S.C. § 371 and claims priority to International Application No. PCT/EP2013/050126 filed on Jan. 4, 2013, and claims the benefit of U.S. Provisional Application No. 61/583,559 filed Jan. 5, 2012, which are hereby incorporated by reference in their entirety into this application.

FIELD OF THE INVENTION

The present disclosure relates to compositions and methods useful for the production of heterologous proteins in filamentous fungal cells.

BACKGROUND

Posttranslational modification of eukaryotic proteins, particularly therapeutic proteins such as immunoglobulins, is often necessary for proper protein folding and function. Because standard prokaryotic expression systems lack the proper machinery necessary for such modifications, alternative expression systems have to be used in production of these therapeutic proteins. Even where eukaryotic proteins do not have posttranslational modifications, prokaryotic expression systems often lack necessary chaperone proteins required for proper folding. Yeast and fungi are attractive options for expressing proteins as they can be easily grown at a large scale in simple media, which allows low production costs, and yeast and fungi have posttranslational machinery and chaperones that perform similar functions as found in mammalian cells. Moreover, tools are available to manipulate the relatively simple genetic makeup of yeast and fungal cells as well as more complex eukaryotic cells such as mammalian or insect cells (De Pourcq et al., Appl Microbiol Biotechnol, 87(5): 1617-31). Despite these advantages, many therapeutic proteins are still being produced in mammalian cells, which produce therapeutic proteins with posttranslational modifications most resembling the native human proteins, whereas the posttranslational modifications naturally produced by yeast and fungi often differ from that found in mammalian cells.

To address this deficiency, new strains of yeast and fungi are being developed that produce posttranslational modifications that more closely resemble those found in native human proteins. Thus, there has been renewed interest in using yeast and fungal cells to express more complex proteins. However, due to the industry's focus on mammalian cell culture technology for such a long time, the fungal cell expression systems such as *Trichoderma* are not as well established as mammalian cell culture and therefore suffer from drawbacks when expressing mammalian proteins.

Thus, a need remains in the art for improved filamentous fungal cells, such as *Trichoderma* fungus cells, that can stably produce heterologous proteins, such as immunoglobulins, preferably at high levels of expression.

SUMMARY

Described herein are compositions including filamentous fungal cells, such as *Trichoderma* fungal cells having reduced or no detectable activity of at least three proteases, and having a recombinant polynucleotide encoding a heterologous polypeptide that is produced at increased levels. Further described herein are methods of improving heterologous polypeptide stability and methods of making heterologous polypeptides in which the proteases do not have the reduced activity.

Thus one aspect includes filamentous fungal cells having reduced or no detectable activity of at least three proteases, where the cell further contains a recombinant polynucleotide encoding a heterologous polypeptide produced at a level of at least 2-fold higher than the production level of the polypeptide in a corresponding parental filamentous fungal cell in which the proteases do not have the reduced activity. In certain embodiments, when the cell is an *Aspergillus* cell, the total protease activity is reduced to 50% or less of the total protease activity of the corresponding parental *Aspergillus* cell in which the protease do not have reduced activity. In other embodiments, the total protease activity of the filamentous fungal cell is reduced to 49% or less, 31% or less, of the total protease activity of the corresponding parental filamentous fungal cell in which the proteases do not have the reduced activity.

In certain embodiments, the expression level of the at least three proteases is reduced or eliminated. In certain embodiments, genes encoding the three proteases each comprise a mutation that reduces or eliminates the corresponding protease activity. In certain embodiments that may be combined with the preceding embodiments, the three protease encoding genes are pep1, tsp1, and slp1. In other embodiments, the three protease encoding genes are gap1, slp1, and pep1.

In certain embodiments, the fungal cells have reduced or no detectable activity of four endogenous proteases; genes encoding the four proteases each comprise a mutation that reduces or eliminates the corresponding protease activity. In certain embodiments that may be combined with the preceding embodiments, the four protease encoding genes are pep1, tsp1, slp1, and gap1.

In certain embodiments that may be combined with the preceding embodiments, the three or four protease encoding genes are selected from pep1, pep2, pep3, pep4, pep5, pep8, pep11, pep12, tsp1, slp1, slp2, slp3, slp7, gap1, and gap2. In certain embodiments that may be combined with the preceding embodiments, the three or four protease encoding genes are selected from pep1, pep3, pep4, tsp1, slp1, slp2, gap1, and gap2. In certain embodiments, the three or four protease encoding genes are selected from pep1, pep2, pep3, pep4, pep5, gap1, gap2, slp1, slp2, and tsp1.

In other embodiments, the fungal cells have reduced or no detectable activity of five endogenous proteases; genes encoding the five proteases each comprise a mutation that reduces or eliminates the corresponding protease activity. In certain embodiments that may be combined with the preceding embodiments, the five protease encoding genes are pep1, tsp1, slp1, gap1, and pep4. In other embodiments, the five protease encoding genes are pep1, tsp1, slp1, gap1, and gap2.

In certain embodiments, the fungal cells have reduced or no detectable activity of six endogenous proteases; genes encoding the six proteases each comprise a mutation that reduces or eliminates the corresponding protease activity. In certain embodiments, the cell has six protease encoding genes, each of which comprise a mutation that reduces or eliminates the corresponding protease activity, and the six protease encoding genes are pep1, tsp1, slp1, gap1, gap2, and pep4.

In certain embodiments that may be combined with the preceding embodiments, the fungal cells have three to six proteases having reduced or no detectable activity each of the three to six proteases selected from pep1, pep2, pep3, pep4, pep5, tsp1, slp1, slp2, slp3, gap1, and gap2.

In certain embodiments that may be combined with the preceding embodiments, the cell has seven protease encoding genes, each of which comprise a mutation that reduces or eliminates the corresponding protease activity, and the seven protease encoding genes are pep1, tsp1, slp1, gap1, gap2, pep4, and pep 3.

In certain embodiments that may be combined with the preceding embodiments, the cell has eight protease encoding genes, each of which comprise a mutation that reduces or eliminates the corresponding protease activity, and the eight protease encoding genes are pep1, tsp1, slp1, gap1, gap2, pep4, pep3, and pep5.

In certain embodiments that may be combined with the preceding embodiments, the fungal cell has an additional protease having reduced activity, the gene encoding the additional protease comprises a mutation that reduces or eliminates the corresponding protease activity, and the additional protease is selected from pep7, pep8, pep11, pep12, tpp1, gap2, slp3, slp5, slp6, slp7, and slp8.

In certain embodiments that may be combined with the preceding embodiments, the heterologous polypeptide is a mammalian polypeptide. In certain embodiments, the mammalian polypeptide is glycosylated.

In certain embodiments, the mammalian polypeptide is selected from an immunoglobulin, an antibody and their antigen-binding fragments, a growth factor, an interferon, a cytokine, and an interleukin. In certain embodiments, the mammalian polypeptide is an immunoglobulin or an antibody. In certain embodiments, the mammalian polypeptide is selected from insulin-like growth factor 1 (IGF1), human growth hormone (hGH), and interferon alpha 2b (IFNα2b).

In certain embodiments that may be combined with the preceding embodiments, the heterologous polypeptide is a non-mammalian polypeptide. In certain embodiments, the non-mammalian polypeptide is an aminopeptidase, amylase, carbohydrase, carboxypeptidase, catalase, cellulase, chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase or xylanase.

In certain embodiments that may be combined with the preceding embodiments, the fungal cell further contains reduced or no detectable activity of ALG3, a mannosyltransferase enzyme. In certain embodiments, the gene encoding ALG3 contains a mutation that reduces or eliminates the corresponding activity. In certain embodiments that may be combined with the preceding embodiments, the fungal cell further contains a polynucleotide encoding an α-1,2-mannosidase.

In certain embodiments that may be combined with the preceding embodiments, the fungal cell has a mutation that reduces the expression of a protease desired to have reduced activity. In certain embodiments that may be combined with the preceding embodiments, the mutation is a deletion within the gene encoding the protease. In certain embodiments that may be combined with the preceding embodiments, the mutation is a deletion of the portion of the gene encoding the catalytic domain of the protease. In certain embodiments that may be combined with the preceding embodiments, the fungal cell has a point mutation in the portion of the gene encoding the catalytic domain of the protease.

In other embodiments, the reduction or elimination of protease activity of one or more proteases results from RNAi constructs specific for i) one protease or ii) two or more proteases selected from the group consisting of a pep-type, protease, a trypsin-like serine protease, a gap-type protease, a sedolisin protease and a slp-type, protease. In certain embodiments, RNAi constructs are specific for slp2, slp3, slp5 and/or slp6.

In certain embodiments that may be combined with the preceding embodiments, the fungal cell further contains an N-acetylglucosaminyltransferase I catalytic domain and an N-acetylglucosaminyltransferase II catalytic domain. In certain embodiments, the N-acetylglucosaminyltransferase I catalytic domain and the N-acetylglucosaminyltransferase II catalytic domain are encoded by a polynucleotide. In certain embodiments, the N-acetylglucosaminyltransferase I catalytic domain is encoded by a first polynucleotide and the N-acetylglucosaminyltransferase II catalytic domain is encoded by a second polynucleotide. In certain embodiments that may be combined with the preceding embodiments, the fungal cell further contains a polynucleotide encoding a mannosidase II and/or a galactosyl transferase. In certain embodiments, the fungal cell contains enzymes selected from the group consisting of oc1,2 mannosidase, N-acetylglucosaminyltransferase I, N-acetylglucosaminyltransferase II, mannosidase II and/or galactosyltransferase, said enzymes further comprising a targeting peptide, for example a heterologous targeting peptide for proper localization of the corresponding enzyme. In certain embodiments, the targeting peptide is selected from SEQ ID NOs: 589-594.

In certain embodiments that may be combined with the preceding embodiments, the fungal cell is a *Trichoderma* fungal cell, a *Myceliophthora* fungal cell, an *Aspergillus* fungal cell, a *Neurospora* fungal cell, a *Fusarium* or *Penicilium* fungal cell, or a *Chrysosporium* fungal cell. In certain embodiments that may be combined with the preceding embodiments, the fungal cell is *Trichoderma reesei*.

In certain embodiments that may be combined with the preceding embodiments, the fungal cell is wild type for pep4 protease.

Another aspect includes methods of improving heterologous polypeptide stability, by: a) providing the filamentous fungal cell of any of the preceding embodiments; and b) culturing the cell such that the heterologous polypeptide is expressed, where the heterologous polypeptide has increased stability compared to the heterologous polypeptide produced in a corresponding parental filamentous fungal cell in which the proteases do not have reduced activity, for example, as not containing the mutations of the genes encoding the proteases. Another aspect includes methods of making a heterologous polypeptide, by: a) providing the filamentous fungal cell of any of the preceding embodiments; b) culturing the host cell such that the heterologous polypeptide is expressed; and c) purifying the heterologous polypeptide. In certain embodiments that may be combined with the preceding embodiments, the filamentous fungal cell further contains a carrier protein. In certain embodiments, the carrier protein is CBHI. In certain embodiments that may be combined with the preceding embodiments, the culturing is in a medium comprising a protease inhibitor. In certain embodiments, the culturing is in a medium having one or two protease inhibitors selected from SBT1 and chymostatin. In certain embodiments, the heterologous polypeptide produced according to the method is a glycosylated mammalian polypeptide and at least 10%, at least 20%, at least 30%, at least 40%, at least 50%, at least 60%, at least 70%, at least 80%, at least 90%, or 100% (mole %) of the total N-glycans of the polypeptide consists of $Man_3GlcNAc_2$ N-glycan. In other embodiments, the heterologous polypeptide produced according to the method is a glycosylated mammalian polypeptide and at least 10%, at least 20%, at least 30%, at least 40%, at least 50%, at least 60%, at least 70%, at least 80%, at least 90%, or 100% (mole %) of the total N-glycans of the polypeptide consists of complex N-glycan. In certain embodiments, the heterologous polypeptide produced according to the method is a glycosylated mammalian polypeptide and at least 10%, at least 20%, at least 30%, at least 40%, at least 50%, at least 60%, at least 70%, at least 80%, at least 90%, or 100% (mole %) of the total N-glycans of the polypeptide consists of hybrid N-glycan. In certain embodiments, the heterologous polypeptide produced according to the method is a glycosylated mammalian polypeptide and at least 10%, at least 20%, at least 30%, at least 40%, at least 50%, at least 60%, at least 70%, at least 80%, at least 90%, or 100% (mole %) of the total N-glycans of the polypeptide consists of G1 or G2 N-glycan. Another aspect includes the heterologous polypeptides obtainable by the methods as described above.

Another aspect includes *Trichoderma* fungal cells having reduced or no detectable activity of at least three proteases selected from pep1, pep2, pep3, pep4, pep5, tsp1, slp1, slp2, gap1, and gap2, where the cell further contains a recombinant polynucleotide encoding a mammalian polypeptide produced at a level of at least 2-fold higher than the production level of the polypeptide in a corresponding parental *Trichoderma* fungal cell.

In certain embodiments, the expression level of the at least three proteases is reduced or eliminated in the *Trichoderma* fungal cell. In certain embodiments, genes encoding the at least three proteases each comprise a mutation that reduces or eliminates the corresponding protease activity in the *Trichoderma* fungal cell. In certain embodiments, the *Trichoderma* fungal cell includes three protease encoding genes with a mutation that reduces or eliminates protease activity, which are selected from gap1, slp1, and pep1. In certain embodiments that may be combined with the preceding embodiments, the mammalian polypeptide in the *Trichoderma* fungal cell is an antibody, or their antigen-binding fragments, or an immunoglobulin, and the at least three proteases are selected from pep1, pep3, pep4, tsp1, slp1, slp2, gap1, and gap2. In certain embodiments, the *Trichoderma* fungal cell contains four protease encoding genes, each of which comprise a mutation that reduces or eliminates the corresponding protease activity, and the four protease encoding genes with such mutation are pep1, tsp1, slp1, and gap1. In certain embodiments, the *Trichoderma* fungal cell has five protease encoding genes, each of which comprise a mutation that reduces or eliminates the corresponding protease activity, and the five protease encoding genes with such mutation are pep1, tsp1, slp1, gap1, and pep4. In certain embodiments that may be combined with the preceding embodiments, the mammalian polypeptide in the *Trichoderma* fungal cell is a growth factor, interferon, cytokine, or interleukin, and the three proteases with reduced activity are selected from pep1, pep2, pep3, pep4, pep5, pep8, pep11, pep12, gap1, gap2, slp1, slp2, slp7, and tsp1. In certain embodiments, the *Trichoderma* fungal cell has five protease encoding genes, each of which comprise a mutation that reduces or eliminates the corresponding protease activity, and the five protease encoding genes with such mutation are pep1, tsp1, slp1, gap1, and gap2. In certain embodiments, the *Trichoderma* fungal cell has six protease encoding genes, each of which comprise a mutation that reduces or eliminates the corresponding protease activity, and the six protease encoding genes with such mutation are pep1, tsp1, slp1, gap1, gap2, and pep4. In certain embodiments that may be combined with the preceding embodiments, the *Trichoderma* fungal cell has seven protease encoding genes, each of which comprise a mutation that reduces or eliminates the corresponding protease activity, and the seven protease encoding genes are pep1, tsp1, slp1, gap1, gap2, pep4, and pep3. In certain embodiments that may be combined with the preceding embodiments, the *Trichoderma* fungal cell has eight protease encoding genes, each of which comprise a mutation that reduces the corresponding protease activity, and the eight protease encoding genes with such mutation are pep1, tsp1, slp1, gap1, gap2, pep4, pep3, and pep5.

In certain embodiments that may be combined with the preceding embodiments, the *Trichoderma* fungal cell further contains reduced or no detectable activity of one or more additional proteases. In certain embodiments, the expression level of the one or more additional proteases in the *Trichoderma* fungal cell is reduced or eliminated. In certain embodiments, genes encoding the one or more additional protease in the *Trichoderma* fungal cell each have a mutation that reduces or eliminates the corresponding protease activity. In certain embodiments that may be combined with the preceding embodiments, the one or more additional protease encoding genes are selected from pep7, pep8, pep11, pep12, tpp1, gap2, slp3, slp5, slp6, slp7, and slp8.

In certain embodiments that may be combined with the preceding embodiments, the *Trichoderma* fungal cell further contains reduced or no detectable activity of ALG3. In certain embodiments, the gene encoding ALG3 in the *Trichoderma* fungal cell contains a mutation that reduces or eliminates the corresponding activity. In certain embodiments that may be combined with the preceding embodiments, the *Trichoderma* fungal cell further contains a polynucleotide encoding an α-1,2-mannosidase. In certain embodiments that may be combined with the preceding embodiments, the mutation reduces or eliminates the expression of the gene in the *Trichoderma* fungal cell. In certain embodiments that may be combined with the preceding embodiments, the mutation is a deletion of the gene in the *Trichoderma* fungal cell. In certain embodiments that may be combined with the preceding embodiments, the mutation is a deletion of the portion of the gene encoding the catalytic domain of the protease in the *Trichoderma* fungal cell. In certain embodiments that may be combined with the preceding embodiments, the mutation is a point mutation in the portion of the gene encoding the catalytic domain of the protease in the *Trichoderma* fungal cell. In certain embodiments that may be combined with the preceding embodiments, the *Trichoderma* fungal cell further contains a N-acetylglucosaminyltransferase I catalytic domain and an N-acetylglucosaminyltransferase II catalytic domain. In certain embodiments, the N-acetylglucosaminyltransferase I catalytic domain and the N-acetylglucosaminyltransferase II catalytic domain are encoded by a polynucleotide of the *Trichoderma* fungal cell. In certain embodiments, the N-acetylglucosaminyltransferase I catalytic domain is encoded by a first polynucleotide and the N-acetylglucosaminyltransferase II catalytic domain is encoded by a second polynucleotide of the *Trichoderma* fungal cell. In certain embodiments that may be combined with the preceding embodiments, the *Trichoderma* fungal cell further contains a polynucleotide encoding a mannosidase II. In certain embodiments, the proteases each have at least 70%, at least 75%, at least 80%, at least 85%, at least 90%, at least 95%, at least 96%, at least 97%, at least 98%, at least 99%, or 100% sequence identity to an amino acid sequence selected from SEQ ID NOs: 1, 17, 37, 58, 66, 82, 98, 118, 129, 166, and 182. In certain embodiments, the total protease activity in the *Trichoderma* fungal cell is reduced to 49% or less, 31% or less of the total protease activity of the corresponding *Trichoderma* parental cell in which the proteases do not have the reduced activity. In certain embodiments that may be combined with the preceding embodiments, the cell further contains a recombinant polynucleotide encoding a mammalian polypeptide produced at a level of at least 2-fold higher than the production level of the polypeptide in a corresponding parental *Trichoderma* fungal cell. In certain embodiments that may be combined with the preceding embodiments, the mammalian polypeptide is produced in a full length version at a level higher than the production level of the full-length version of the polypeptide in a corresponding parental *Trichoderma* fungal cell.

Another aspect includes methods of improving heterologous polypeptide stability, by: a) providing the *Trichoderma* fungal cell of any of the preceding embodiments; and b) culturing the cell such that the heterologous polypeptide is expressed, where the heterologous polypeptide has increased stability compared to a host cell not containing the mutations of the genes encoding the proteases. Another aspect includes methods of making a heterologous polypeptide, by: a) providing the *Trichoderma* fungal cell of any of the preceding embodiments; b) culturing the host cell such that the heterologous polypeptide is expressed; and c) purifying the heterologous polypeptide. In certain embodiments that may be combined with the preceding embodiments, the filamentous fungal cell further contains a carrier protein. In certain embodiments, the carrier protein is CBHI.

DESCRIPTION OF THE FIGURES

FIG. 3A depicts the expected signal of pep1 ORF: >8 kb from parent M127, no signal from transformants. FIG. 3B depicts the expected signal of pep1 5'flank: >8 kb from parent M127, 4 kb from transformants. FIG. 3C depicts the expected signal of pep1 3'flank: >8 kb from parent M127, 4.2 kb from transformants.

FIG. 4A depicts the expected signal of pep1 ORF: >8 kb from parent M169, no signal from transformants. FIG. 4B depicts the expected signal of bar. 1.0+1.7 kb from transformants, 3.1 kb from pTTv41, nothing from M169. FIG. 4C depicts the expected signal of bar. 1.8+2.8 kb from transformants, 3.1 kb from pTTv41, nothing from M169.

FIG. 8A depicts the effects of protease activity on MAB01 at pH 5.5. FIG. 8B depicts the effects of protease activity on MAB01 at pH 4.5. FIG. 8C depicts the effects of protease activity on native IGF-1 at pH 4.5.

FIG. 12A shows MAB01 heavy chain production. FIG. 12B shows MAB01 light chain production.

FIG. 14A shows production of MAB01 heavy chain (HC). FIG. 14B shows the production of MAB01 light chain (LC).

FIG. 18A depicts the expected signal of tsp1 ORF: 6.4 kb from parent M196. FIG. 18B depicts the expected signal of tsp1 5' flank: 3.9 kb from transformants, >8 kb from M196, 3.9 kb from pTTv72. FIG. 18C depicts the expected signal of tsp1 3' flank: 2.8 kb from transformants, >8 kb from M196, 3.9 kb from pTTv72.

FIG. 19A depicts the expected signal of tsp1 ORF: kb from parent M181. FIG. 19B depicts the expected signal of bar. 1.4+2.5 kb from transformants, 2.9 kb from pTTv42, nothing from M181. FIG. 19C depicts the expected signal of bar. 1.9+3.2 kb from transformants, 2.9 kb from pTTv42, nothing from M181.

FIG. 21A depicts the results of an MAB02 zymogram with aminobenzamidine purified fractions from fermentation supernatants. FIG. 21B depicts an SDS PAGE gel (7%) of aminobenzamidine purified fractions from fermentation supernatants.

FIG. 25A shows protease degradation of rituximab heavy chain. FIG. 25B shows protease degradation of MAB01 heavy chain.

FIG. 26A depicts the expected signal of slp1 ORF: 6.5 kb from parents (M219, M228) only. FIG. 26B depicts the expected signal of slp1 5'flank: 6.5 kb from parents, 3.3 kb from transformants, 4.4 kb from plasmid control pTTv126. FIG. 26C depicts the expected signal of slp1 3'flank: 6.5 kb from parents, 2.3 kb from transformants, 4.4 kb from plasmid control pTTv126.

FIG. 29A depicts the expected signal of gap1 ORF: 4 kb from parent (Mill 2A=M306) only. FIG. 29B depicts the expected signal of gap1 5'flank: 5.5 kb from parent, 3.4 kb from transformants, 4.1 kb from plasmid control pTTv1 17. FIG. 29C depicts the expected signal of gap1 3'flank: 5.5 kb from parent, 3.1 kb from transformants, 4.1 kb from plasmid control pTTv1 17.

FIG. 32A depicts the expected signal of gap2 ORF: 4.9 kb from parent (M307), no signals from transformant. FIG. 32B depicts the expected signal of gap2 5' flank: 4.9 kb from parent, 2.3 kb from transformant, 2.3 kb from plasmid control pTTv145. FIG. 32C depicts the expected signal of gap2 3' flank: 4.9 kb from parent, 3.8 kb from transformants, 3.8 kb from plasmid control pTTv145. FIG. 32D depicts Southern blot analysis showing the generation of the pyr4– from the quintuple protease deletion strain M369, resulting in strain M381 (clone 14). M307=4-fold del strain, M369=5-fild del strain. The expected signal is gap2 5' flank: 1.5 kb from all strains, 4.1 kb from plasmid control pTTv145. FIG. 32E depicts Southern blot analysis showing the generation of the pyr4– from the quintuple protease deletion strain M369, resulting in strain M381 (clone 14). The expected signal is gap2 3'flank: 3.6 kb from M307, 2.7 kb from M369+loopout clones, 3.8 kb from plasmid control pTTv145.

FIG. 34A depicts the expected signal of pep4 ORF: 6.3 kb from M307 and M369, no signals from transformants. FIG. 34B depicts the expected signal of pep4 ORF: 6.3 kb from M307 and M369, no signals from transformants. FIG. 34C depicts the expected signal of pep4 5' flank: 6.3 kb from M307 and M369, 4.8 kb from transformants, 4.0 kb from pTTv181. FIG. 34D depicts the expected signal of pep4 3' flank: 6.3 kb from M307 and M369, 2.1 kb from transformants, 4.0 kb from pTTv181. FIG. 34E depicts Southern blot analysis showing the generation of pyr4– from 6-fold protease deletion strains M396. The expected signal of is pep4 3' flank: 6.3 kb from M307 and M369, 2.1 kb from repurified transformants, 4.9 kb from the loopout clones.

FIG. 36A shows degradation of the heavy chain. FIG. 36B shows the degradation of the light chain.

FIG. 37A shows the degradation of the light chain. FIG. 37B shows degradation of the heavy chain.

Figure 1:
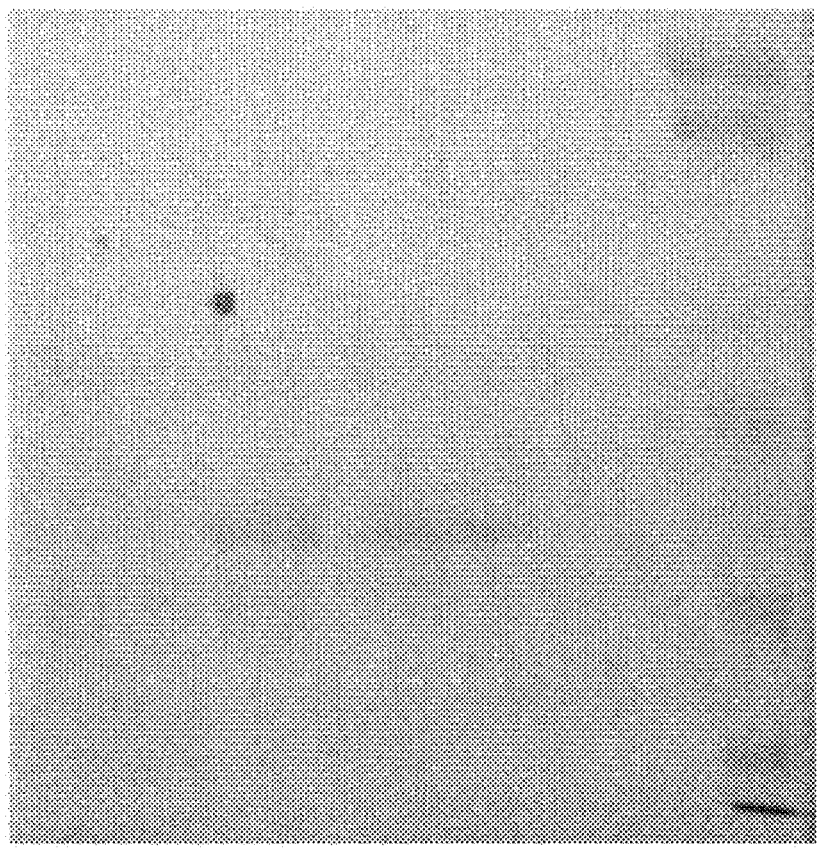
FIG. 1 depicts a PAGE gel showing fractions eluted from affinity column purification of aspartic proteases.

Immunoblotting was done with Abcam (#ab9386) anti-IFN-α 2b antibody diluted to 1 µg/ml in TBST. The secondary antibody from Bio-rad (#170-6520) goat anti-mouse IgG AP conjugated secondary antibody diluted 1:5000 in TBST. The protein standards were loaded on the gel corresponding 50 ng, 100 ng and 200 ng of full length IFN-α 2b. Densitometric quantification was done with Totallab Quant TL100 software. For the quantification 0.1 µl samples were most representative. Full length IFN-α 2b control (100 ng) runs at 19.3 kD and carrier bound IFN-α 2b at 70 kDa.

DETAILED DESCRIPTION

The present invention relates to improved methods of generating recombinant heterologous polypeptides in filamentous fungal cells that have reduced or no activity of at least three proteases. The present invention is based in part upon the surprising discovery that reducing the activity of a specific combination of endogenous proteases in filamentous fungal cells increases the expression and stability of a variety of recombinantly expressed heterologous proteins, such as immunoglobulins and growth factors. While others have created *Trichoderma* fungal cells with one or more proteases inactivated, they have not provided guidance as to which proteases are most relevant to increasing the expression and stability of specific types of proteins, such as mammalian proteins. For example, WO2011/075677 discloses certain proteases that can be knocked out in *Trichoderma* and even discloses *Trichoderma* fungal cells that are deficient in multiple proteases. However, WO2011/075677 does not provide any guidance regarding which of the proteases have an adverse impact on the expression and stability of mammalian proteins, such as immunoglobulins or growth factors, as no examples of expression of any mammalian proteins are described therein. Moreover, WO2011/075677 only discloses heterologous expression of a single fungal protein in each of three different fungal strains deficient in a single protease. Thus, one of skill in the art would likely read WO2011/075677 as teaching that inactivating each single protease would be sufficient for heterologous protein production. Yoon et al (2009, Appl. Microbiol Biotechnol 82: 691-701, 2010: Appl. Microbiol Biotechnol DOI 10.1007/s00253-010-2937-0) reported the construction of quintuple and ten fold protease gene disruptants for heterologous protein production in *Aspergillus oryzae*. The 10 protease disruptant cells improve the production yield of chymosin by only 3.8 fold, despite the high number of disrupted protease genes. Van den Hombergh et al reported a triple protease gene disruptant of *Aspergillus niger*. While the data show a reduction in protease activity, there is no example of any mammalian protein production described herein.

Applicants have surprisingly shown that multiple proteases are relevant to reduction of total protease activity, increasing production of heterologous proteins and stabilizing the heterologous proteins after expression, in filamentous fungal cells, such as *Trichoderma* fungal cells. In particular, the inventors have identified proteases that are actually expressed in *Trichoderma* fungal cells (as opposed to merely being coded for in the genome) by purifying these proteases and determining which have activities that are most relevant in degrading heterologous proteins, such as mammalian proteins. Additionally, the inventors confirmed that deleting the genes responsible for the particular protease activities achieved a substantial reduction in total protease activity, which correlates to an increase in protein stabilization in terms of both quantity and quality of proteins produced in filamentous fungal cells containing such deletions, and resulted in an increase in the production of full length heterologous proteins in the cells. It was also found that *Trichoderma* fungal cells engineered to reduce the activity of at least three protease genes resulted in an unexpected, synergistic increase in the production of full length mammalian proteins, such as antibodies, therapeutic protein or antibody variants such Fab or single domain antibodies. In other words, the amount of full length mammalian protein produced was greater than the sum of the amounts produced in *Trichoderma* fungal cells containing only one or two protease gene deletions. Thus, in contrast to WO2011/075677, the inventors have shown that production of intact heterologous proteins in filamentous fungal cells, such as *Trichoderma* fungal cells, can be achieved by reducing or eliminating the activity of at least three proteases in the cells.

Accordingly, certain aspects of the present disclosure provide filamentous fungal cells that produce increased levels of a heterologous protein by having reduced or no activity of at least three proteases, where the cell further contains a recombinant polynucleotide encoding a heterologous polypeptide produced at a level of at least 2-fold higher than the production level of the polypeptide in a corresponding parental filamentous fungal cell in which the proteases do not have the reduced activity. In other words, the desired increase in the level of the heterologous protein production is determinable by comparing the production level of the heterologous protein in a filamentous fungal cell having the reduced activity of at least three proteases, to that of a filamentous fungal cell which does not have such reduced activity, but is otherwise identical to the cell exhibiting the increased level.

Other aspects of the present disclosure provide methods of improving heterologous polypeptide stability, by: a) providing a filamentous fungal cell of the present disclosure having reduced or no activity of at least three proteases, where the cell further contains a recombinant polynucleotide encoding a heterologous polypeptide; and b) culturing the cell such that the heterologous polypeptide is expressed, where the heterologous polypeptide has increased stability compared to a host cell not containing the mutations of the genes encoding the proteases.

Still other aspects of the present disclosure provide methods of making a heterologous polypeptide, by: a) providing a filamentous fungal cell of the present disclosure having reduced or no activity of at least three proteases, where the cell further contains a recombinant polynucleotide encoding a heterologous polypeptide; b) culturing the host cell such that the heterologous polypeptide is expressed; and c) purifying the heterologous polypeptide.

Certain aspects of the present disclosure also provide *Trichoderma* fungal cells that produce increased levels of a mammalian polypeptide by having reduced or no activity of at least three proteases selected from pep1, pep2, pep3, pep4, pep5, pep8, pep11, pep12, tsp1, slp1, slp2, gap1, and gap2, where the cell further contains a recombinant polynucleotide encoding a mammalian polypeptide produced at a level of at least 2-fold higher than the production level of the polypeptide in a corresponding parental *Trichoderma* fungal cell in which the proteases do not have the reduced activity. In other words, the desired increase in the level of the heterologous protein production is determinable by comparing the production level of the heterologous protein in a *Trichoderma* fungal cell having the reduced activity of at least three proteases, to that of a *Trichoderma* fungal cell which does not have such reduced activity, but is otherwise identical to the cell exhibiting the increased level.

Other aspects of the present disclosure provide methods of improving mammalian polypeptide stability, by: a) providing a *Trichoderma* fungal cell of the present disclosure having reduced activity of at least three proteases, where the cell further contains a recombinant polynucleotide encoding a mammalian polypeptide; and b) culturing the cell such that the mammalian polypeptide is expressed, where the mammalian polypeptide has increased stability compared to a host cell not containing the mutations of the genes encoding the proteases.

Further aspects of the present disclosure provide methods of making a mammalian polypeptide, by: a) providing a *Trichoderma* fungal cell of the present disclosure having reduced activity of at least three proteases, where the cell further contains a recombinant polynucleotide encoding a mammalian polypeptide; b) culturing the host cell such that the mammalian polypeptide is expressed; and c) purifying the mammalian polypeptide.

Definitions

As used herein, an "immunoglobulin" refers to a multimeric protein containing a heavy chain and a light chain covalently coupled together and capable of specifically combining with antigen. Immunoglobulin molecules are a large family of molecules that include several types of molecules such as IgM, IgD, IgG, IgA, and IgE.

As used herein, an "antibody" refers to intact immunoglobulin molecules, as well as fragments thereof which are capable of binding an antigen. These include hybrid (chimeric) antibody molecules (see, e.g., Winter et al. Nature 349:293-99225, 1991; and U.S. Pat. No. 4,816,567 226); F(ab')2 and F(ab) fragments and Fv molecules; non-covalent heterodimers [227, 228]; single-chain Fv molecules (scFv) (see, e.g., Huston et al. Proc. Natl. Acad. Sci. U.S.A. 85:5897-83, 1988); dimeric and trimeric antibody fragment constructs; minibodies (see, e.g., Pack et al. Biochem 31, 1579-84, 1992; and Cumber et al. J. Immunology 149B, 120-26, 1992); humanized antibody molecules (see e.g., Riechmann et al. Nature 332, 323-27, 1988; Verhoeyan et al. Science 239, 1534-36, 1988; and GB 2,276,169); and any functional fragments obtained from such molecules, as well as antibodies obtained through non-conventional processes such as phage display. Preferably, the antibodies are monoclonal antibodies. Methods of obtaining monoclonal antibodies are well known in the art.

As used herein, a "peptide" and a "polypeptide" are amino acid sequences including a plurality of consecutive polymerized amino acid residues. For purpose of this invention, typically, peptides are those molecules including up to 50 amino acid residues, and polypeptides include more than 50 amino acid residues. The peptide or polypeptide may include modified amino acid residues, naturally occurring amino acid residues not encoded by a codon, and non-naturally occurring amino acid residues. As used herein, "protein" may refer to a peptide or a polypeptide of any size.

Proteases of the Invention

The invention described herein relates to filamentous fungal cells, such as *Trichoderma* fungal cells, that produce increased levels of a heterologous polypeptide, such as a mammalian polypeptide, by having reduced or no detectable activity of at least three proteases found in the cells. Such proteases found in filamentous fungal cells that express a heterologous polypeptide normally catalyze significant degradation of the expressed recombinant polypeptides. Thus, by reducing or eliminating the activity of proteases in filamentous fungal cells that express a heterologous polypeptide, the stability of the expressed polypeptide is increased, resulting in an increased level of production of the polypeptide, and in some circumstances, improved quality of the produced polypeptide (e.g., full-length instead of degraded).

Proteases including, without limitation, aspartic proteases, trypsin-like serine proteases, subtilisin proteases, glutamic proteases, and sedolisin proteases. Such proteases may be identified and isolated from filamentous fungal cells and tested to determine whether reduction in their activity affects the production of a recombinant polypeptide from the filamentous fungal cell. Methods for identifying and isolating proteases are well known in the art, and include, without limitation, affinity chromatography, zymogram assays, and gel electrophoresis. An identified protease may then be tested by deleting the gene encoding the identified protease from a filamentous fungal cell that expresses a recombinant polypeptide, such a heterologous or mammalian polypeptide, and determining whether the deletion results in a decrease in total protease activity of the cell, for example, to a level of 49% or less, or 31% or less, of the total protease activity of the corresponding parental filamentous fungal cell; and an increase in the level of production of the expressed recombinant polypeptide, for example two-fold higher than the production level in the corresponding parental filamentous fungal cell. Methods for deleting genes, measuring total protease activity, and measuring levels of produced protein are well known in the art and include the methods described herein. The "corresponding parental filamentous fungal cell" refers to the corresponding cell in which the proteases do not have reduced or eliminated activity.

Aspartic Proteases

Aspartic proteases are enzymes that use an aspartate residue for hydrolysis of the peptide bonds in polypeptides and proteins. Typically, aspartic proteases contain two highly-conserved aspartate residues in their active site which are optimally active at acidic pH. Aspartic proteases from eukaryotic organisms such as *Trichoderma* fungi include pepsins, cathepsins, and renins. Such aspartic proteases have a two-domain structure, which is thought to arise from an ancestral gene duplication. Consistent with such a duplication event, the overall fold of each domain is similar, though the sequences of the two domains have begun to diverge. Each domain contributes one of the catalytic aspartate residues. The active site is in a cleft formed by the two domains of the aspartic proteases. Eukaryotic aspartic proteases further include conserved disulfide bridges, which can assist in identification of the polypeptides as being aspartic acid proteases.

Nine aspartic proteases have been identified in *Trichoderma* fungal cells: pep1 (tre74156); pep2 (tre53961); pep3 (tre121133); pep4 (tre77579), pep5 (tre81004), and pep7 (tre58669), pep8 (tre122076), pep11 (tre121306) and pep12 (tre1 19876).

Pep1

Examples of suitable pep1 proteases include, without limitation, *Trichoderma reesei* pep1 (SEQ ID NO: 1), *Hypocrea lixii* gi|11558498 (SEQ ID NO: 2), *Trichoderma asperellum* gi|47027997 (SEQ ID NO: 3), *Trichoderma atroviride* jgi|Triat21297887 (SEQ ID NO: 4), *Trichoderma virens* jgi|TriviGv29_8_2181777 (SEQ ID NO: 5), *Aspergillus fumigatus* jgi|Trire2lafm:Afu5g13300 (SEQ ID NO: 6), *Aspergillus oryzae* gi|194730408 (SEQ ID NO: 7), *Metarhizium anisopliae* gi|322712783 (SEQ ID NO: 8), *Gibberella zeae* gi|46126795 (SEQ ID NO: 9), *Fusarium venenatum* gi|18448713 (SEQ ID NO: 10), *Fusarium oxysporum* gi|342879173 (SEQ ID NO: 11), *Grosmannia clavigera* gi|320591399 (SEQ ID NO: 12), *Verticillium alboatrum* gi|302422750 (SEQ ID NO: 13), *Chaetomium globosum* gi| 16182964 (SEQ ID NO: 14), *Neurospora crassa* gi|85110723 (SEQ ID NO: 15), *Neurospora tetrasperma* gi|336463990 (SEQ ID NO: 16), *Myceliophthora thermophila* gi367030924 (SEQ ID NO: 491), *Penicillium chrysogenum* gi255953325 (SEQ ID NO: 492), *Aspergillus niger* gi350639535 (SEQ ID NO: 493), *Aspergillus nidulans* gi67541436 (SEQ ID NO: 494), and homologs thereof.

Accordingly, in certain embodiments, a protease of the present disclosure, typically a pep1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 1-16, SEQ ID NOs: 491-494. In some embodiments, the protease has 100% identity to an amino acid sequence selected from SEQ ID NOs: 1-16, SEQ ID NOs:491-494.

In some embodiments, pep1 is *T. reesei* pep1. The amino acid sequence encoded by *T. reesei* pep1 is set forth in SEQ ID NO: 1. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 1. In further embodiments, the protease has 100% identity to SEQ ID NO: 1.

Pep2

Examples of suitable pep2 proteases include, without limitation, *Trichoderma reesei* pep2 (SEQ ID NO: 182), *T atroviride* jgi\Triat21142040 (SEQ ID NO: 183), *T virens* jgi|TriviGv29_8_2153481 (SEQ ID NO: 184), *Cordyceps militaris* CM01 gi|346326575 (SEQ ID NO: 185), *Neurospora crassa* gi 85111370 (SEQ ID NO: 495), and homologs thereof.

Accordingly, in certain embodiments, a protease of the present disclosure, typically a pep2 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 182-185, SEQ ID NO:495. In some embodiments, the protease has 100% identity to an amino acid sequence selected from SEQ ID NOs: 182-185, SEQ ID NO:495.

In some embodiments, pep2 is *T. reesei* pep2. The amino acid sequence encoded by *T. reesei* pep2 is set forth in SEQ ID NO: 182. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 182. In further embodiments, the protease has 100% identity to SEQ ID NO: 182.

Pep3

Examples of suitable pep3 proteases include, without limitation, *Trichoderma reesei* pep3 (SEQ ID NO: 17), *T atroviride* jgi|Triat2 (SEQ ID NO: 18), *T virens*, jgi|TriviGv29_8_2 (SEQ ID NO: 19), *Hypocrea lixii* gi|| 45583125 (SEQ ID NO: 20), *Trichoderma asperellum* gi|51860175 (SEQ ID NO: 21), *Aspergillus niger* gi|317025164 (SEQ ID NO: 22), *Aspergillus fumigatus* gi|159122534 (SEQ ID NO: 23), *Aspergillus niger* gi|134054572 (SEQ ID NO: 24), *Cordyceps militaris*, gi|346318620 (SEQ ID NO: 25), *Glomerella graminicola* gi|310800156 (SEQ ID NO: 26), *Fusarium oxysporum* gi|342871221 (SEQ ID NO: 27), *Grosmannia clavigera* gi|320591121 (SEQ ID NO: 28), *Botryotinia fuckeliana* gi|12002205 (SEQ ID NO: 29), *Thielavia terrestris* gi|346997107 (SEQ ID NO: 30), *Sclerotinia sclerotiorum* gi|156055954 (SEQ ID NO: 31), *Chaetomium globosum* gi|| 16197829 (SEQ ID NO: 32), *Neurospora tetrasperma* gi|336472132 (SEQ ID NO: 33), *Neurospora crassa* gi|85102020 (SEQ ID NO: 34), *Neosartorya fischeri* gi|119467426 (SEQ ID NO: 35), *Penicillium marneffei* gi|212534792 (SEQ ID NO: 36), *M. thermophila* gi367025909 (SEQ ID NO: 496), *P. chrysogenum* gi255947264 (SEQ ID NO: 497), *A. oryzae* 391870123 (SEQ ID NO: 498), and homologs thereof.

Accordingly, in certain embodiments, a protease of the present disclosure, typically a pep3 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 17-36, SEQ ID NOs:496-498. In some embodiments, the protease has 100% identity to an amino acid sequence selected from SEQ ID NOs: 17-36, SEQ ID NOs:496-498.

In some embodiments, pep3 is *T. reesei* pep3. The amino acid sequence encoded by *T. reesei* pep3 is set forth in SEQ ID NO: 17. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 17. In further embodiments, the protease has 100% identity to SEQ ID NO: 17.

Pep4

Examples of suitable pep4 proteases include, without limitation, *Trichoderma reesei* pep4 (SEQ ID NO: 37), *T virens* jgi|TriviGv29_8_2 (SEQ ID NO: 38), *T atroviride* jgi|Triat2 (SEQ ID NO: 39), *Trichoderma aureoviride* gi||93735605 (SEQ ID NO: 40), *Aspergillus niger* gi|145232965 (SEQ ID NO: 41), *Aspergillus fumigatus* gi|70999520 (SEQ ID NO: 42), *Aspergillus clavatus* gi||21705756 (SEQ ID NO: 43), *Nectria haematococca* gi|302899226 (SEQ ID NO: 44), *Glomerella graminicola* gi|310796316 (SEQ ID NO: 45), *Cordyceps militaris* gi|346322842 (SEQ ID NO: 46), *Gibberella zeae* gi|46138535 (SEQ ID NO: 47), *Metarhizium anisopliae* gi|322708430 (SEQ ID NO: 48), *Fusarium oxysporum* gi|342882947 (SEQ ID NO: 49), *Metarhizium acridum* gi|322700747 (SEQ ID NO: 50), *Verticillium dahliae*, gi|346973691 (SEQ ID NO: 51), *Botryotinia fuckeliana* gi||54309857 (SEQ ID NO: 52), *Chaetomium globosum* gi||116203505 (SEQ ID NO: 53), *Thielavia terrestris* gi|347001590 (SEQ ID NO: 54), *Magnaporthe oryzae* gi|39973863 (SEQ ID NO: 55), *Tuber melanosporum* gi|296417651 (SEQ ID NO: 56), *Neurospora crassa* gi|85094599 (SEQ ID NO: 57), *M. thermophila* gi367031892 gi255947264 (SEQ ID NO: 499), *P. chrysogenum* gi255936729 gi255947264 (SEQ ID NO: 500), *A. oryzae* gi69770745 gi255947264 (SEQ ID NO: 501), *A. nidulans* gi67524891 gi255947264 (SEQ ID NO: 502), and homologs thereof.

Accordingly, in certain embodiments, a protease of the present disclosure, typically a pep4 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 37-57, SEQ ID NOs:499-502. In some embodiments, the protease has 100% identity to an amino acid sequence selected from SEQ ID NOs: 37-57, SEQ ID NOs:499-502.

In some embodiments, pep4 is *T. reesei* pep4. The amino acid sequence encoded by *T. reeseipep*4 is set forth in SEQ ID NO: 37. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 37. In further embodiments, the protease has 100% identity to SEQ ID NO: 37.

Pep5

Examples of suitable pep5 genes include, without limitation, *Trichoderma reesei* pep5 (SEQ ID NO: 58), T vixens jgi|TriviGv29_8_2 (SEQ ID NO: 59), *T atroviride* jgi|Triat21277859 (SEQ ID NO: 60), *Metarhizium acridum* gi|322695806 (SEQ ID NO: 61), *Fusarium oxysporum* gi|156071418 (SEQ ID NO: 62), *Cordyceps militaris* gi|346324830 (SEQ ID NO: 63), *Gibberella zeae* gi|46124247 (SEQ ID NO: 64), *Verticillium dahliae* gi|346978752 (SEQ ID NO: 65), *M. thermophila* gi367019798 (SEQ ID NO: 503), and homologs thereof.

Accordingly, in certain embodiments, a protease of the present disclosure, typically a pep5 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 58-65, SEQ ID NO:503. In some embodiments, the protease has 100% identity to an amino acid sequence selected from SEQ ID NOs: 58-65, SEQ ID NO:503.

In some embodiments, pep5 is *T. reesei* pep5. The amino acid sequence encoded by *T. reesei* pep5 is set forth in SEQ ID NO: 58. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 58. In further embodiments, the protease has 100% identity to SEQ ID NO: 58.

Pep7

Examples of suitable pep7 genes include, without limitation, *Trichoderma reesei* pep7 (SEQ ID NO: 186), *Trichoderma atroviride* jgi|Triat2 (SEQ ID NO: 187), *Trichoderma virens* jgi|TriviGv29_8_2 (SEQ ID NO: 188), *Glomerella graminicola* gi|310800487 (SEQ ID NO: 189), *Metarhizium acridum* gi|322700577 (SEQ ID NO: 190), *Thielavia terrestris* gi|347003264 (SEQ ID NO: 191), *Podospora anserine* gi|171680938 (SEQ ID NO: 192), *Chaetomium thermophilum* gi|340905460 (SEQ ID NO: 193), *Verticillium dahliae* gi|346975960 (SEQ ID NO: 194), *Myceliophthora thermophila* gi|347009870, gi367026634 (SEQ ID NO: 195), *Neurospora crassa* gi|85090078 (SEQ ID NO: 196), *Magnaporthe oryzae* gi|39948622 (SEQ ID NO: 197), *Chaetomium globosum* gi|116191517 (SEQ ID NO: 198), *Magnaporthe oryzae* gi|39970765 (SEQ ID NO: 199), *A. nidulans* gi|67522232 (SEQ ID NO: 504), *A. niger* gi|350630464 (SEQ ID NO: 505), *A. oryzae* gi|317138074 (SEQ ID NO: 506), and homologs thereof.

Accordingly, in certain embodiments, a protease of the present disclosure, typically a pep7 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 186-199, SEQ ID NOs:504-506). In some embodiments, the protease has 100% identity to an amino acid sequence selected from SEQ ID NOs: 186-199, SEQ ID NOs:504-506.

In some embodiments, pep7 is *T. reesei* pep7. The amino acid sequence encoded by *T. reesei* pep7 is set forth in SEQ ID NO: 186. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 186. In further embodiments, the protease has 100% identity to SEQ ID NO: 186.

Pep8

Examples of suitable pep8 genes include, without limitation, *Trichoderma reesei* pep8 EGR48424 (SEQ ID NO: 507), *Trichoderma virens* EHK19238 (SEQ ID NO: 508), *Trichoderma atroviride* EHK40047 (SEQ ID NO: 509), *Neurospora tetrasperma* EG053367 (SEQ ID NO: 510), *Myceliophthora thermophila* XP_003658897 (SEQ ID NO: 511), *Neurospora crassa* XP_965343 (SEQ ID NO: 512), *Metarhizium anisopliae* EFZ03501 (SEQ ID NO: 513), *Thielavia terrestris* XP_003656869 (SEQ ID NO: 514), *Fusarium oxysporum* EGU79769 (SEQ ID NO: 515), and *Gibberella zeae* XP_381566 (SEQ ID NO: 516), *Magnaporthe oryzae* XP_3714540.1 (SEQ ID NO:517), *P. chrysogenum* XP_002557331 (SEQ ID NO: 518), *A. oryzae* XP_001822899.1 (SEQ ID NO: 519), *A. nidulans* XP_664091.1 (SEQ ID NO: 520), *A. niger* EHA24387.1 (SEQ ID NO: 521), and homologs thereof.

Accordingly, in certain embodiments, a protease of the present disclosure, typically a pep8 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 507-521. In some embodiments, the protease has 100% identity to an amino acid sequence selected from SEQ ID NOs: 507-521.

In some embodiments, pep8 is *T. reesei* pep8. The amino acid sequence encoded by *T. reesei* pep8 is set forth in SEQ ID NO: 507. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 507. In further embodiments, the protease has 100% identity to SEQ ID NO: 507.

Pep 11

Examples of suitable pep11 genes include, without limitation, *Trichoderma reesei* pep11 EGR49498 (SEQ ID NO: 522), *Trichoderma virens* EHK26120 (SEQ ID NO: 523), *Trichoderma atroviride* EHK41756 (SEQ ID NO: 524), *Fusarium pseudograminearum* EKJ74550 (SEQ ID NO: 525), *Metarhizium acridum* EFY91821 (SEQ ID NO: 526), and *Gibberella zeae* XP_384151 (SEQ ID NO: 527), *M. thermophila* XP_003667387.1 (SEQ ID NO: 528), *N. crassa* XP_960328.1 (SEQ ID NO: 529), and homologs thereof.

Accordingly, in certain embodiments, a protease of the present disclosure, typically a pep11 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 522-529. In some embodiments, the protease has 100% identity to an amino acid sequence selected from SEQ ID NOs: 522-529.

In some embodiments, pep11 is *T. reesei* pep8. The amino acid sequence encoded by *T. reesei* pep11 is set forth in SEQ ID NO: 522. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 522. In further embodiments, the protease has 100% identity to SEQ ID NO: 522.

Pep12

Examples of suitable pep12 genes include, without limitation, *Trichoderma reesei* pep12 EGR52517 (SEQ ID NO: 530), *Trichoderma virens* pep12 EHK18859 (SEQ ID NO: 531), *Trichoderma atroviride* pep12 EHK45753 (SEQ ID NO: 532), *Fusarium pseudograminearum* pep12 EKJ73392

(SEQ ID NO: 533), *Gibberella zeae* pep12 XP_388759 (SEQ ID NO: 534), and *Metarhizium anisopliae* pep12 EFY95489 (SEQ ID NO: 535), *N. crassa* XP_964574.1 (SEQ ID NO: 536), *M. thermophila* XP_003659978.1 (SEQ ID NO: 537), and homologs thereof.

Accordingly, in certain embodiments, a protease of the present disclosure, typically a pep12 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 530-537. In some embodiments, the protease has 100% identity to an amino acid sequence selected from SEQ ID NOs: 530-537.

In some embodiments, pep8 is *T. reesei* pep12. The amino acid sequence encoded by *T. reesei* pep12 is set forth in SEQ ID NO: 530. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 530. In further embodiments, the protease has 100% identity to SEQ ID NO: 530.

Trypsin-Like Serine Proteases

Trypsin-like serine proteases are enzymes with substrate specificity similar to that of trypsin. Trypsin-like serine proteases use a serine residue for hydrolysis of the peptide bonds in polypeptides and proteins. Typically, trypsin-like serine proteases cleave peptide bonds following a positively-charged amino acid residue. Trypsin-like serine proteases from eukaryotic organisms such as *Trichoderma* fungi include trypsin 1, trypsin 2, and mesotrypsin. Such trypsin-like serine proteases generally contain a catalytic triad of three amino acid residues (such as histidine, aspartate, and serine) that form a charge relay that serves to make the active site serine nucleophilic. Eukaryotic trypsin-like serine proteases further include an "oxyanion hole" formed by the backbone amide hydrogen atoms of glycine and serine, which can assist in identification of the polypeptides as being trypsin-like serine proteases.

One trypsin-like serine protease has been identified in *Trichoderma* fungal cells: tsp1 (tre73897). As discussed below, tsp1 has been demonstrated to have a significant impact on expression of recombinant polypeptides, such as immunoglobulins.

As discussed below in Example 3, serine proteases were purified from *Trichoderma* and shown to have multiple protease activities that degrade mammalian proteins. Of these activities, tsp1 was identified as a trypsin-like serine protease. The tsp1 protease gene was then deleted from *Trichoderma* fungal cells and it was demonstrated that deleting tsp1 achieved a significant reduction in total protease activity resulting in increased stabilization of mammalian proteins produced by the cells.

Examples of suitable tsp1 proteases include, without limitation, *Trichoderma reesei* tsp1 (SEQ ID NO: 66), *Trichoderma atroviride* jgi|Triat21298187 (SEQ ID NO: 67), jgi|TriviGv29_8_2 (SEQ ID NO: 68), *Hypocrea lixii* gi|145583579 (SEQ ID NO: 69), *Hypocrea lixii* gi|63025000 (SEQ ID NO: 70), *Sclerotinia sclerotiorum* gi|156052735 (SEQ ID NO: 71), *Botryotinia fuckeliana* gi|154314937 (SEQ ID NO: 72), *Phaeosphaeria nodorum* gi|169605891 (SEQ ID NO: 73), *Leptosphaeria maculans* gi|312219044 (SEQ ID NO: 74), *Verticillim dahliae* gi|37992773 (SEQ ID NO: 75), *Cochliobolus carbonum* gi|11072114 (SEQ ID NO: 76), *Metarhizi macridum* gi|322695345 (SEQ ID NO: 77), *Metarhizi manisopliae* gi|4768909 (SEQ ID NO: 78), gi|464963 (SEQ ID NO: 79), *Gibberella zeae* gi|46139299 (SEQ ID NO: 80), *Metarhizium anisopliae* (SEQ ID NO: 81), *A. nidulans* gi|67523821 (SEQ ID NO: 538) and homologs thereof.

Accordingly, in certain embodiments, a protease of the present disclosure, typically tsp1 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 66-81, SEQ ID NO:538. In some embodiments, the protease has 100% identity to an amino acid sequence selected from SEQ ID NOs: 66-81, SEQ ID NO:538.

In some embodiments, tsp1 is *T. reesei* tsp1. The amino acid sequence encoded by *T. reesei* tsp1 is set forth in SEQ ID NO: 66. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 66. In further embodiments, the protease has 100% identity to SEQ ID NO: 66.

Subtilisin Proteases

Subtilisin proteases are enzymes with substrate specificity similar to that of subtilisin. Subtilisin proteases use a serine residue for hydrolysis of the peptide bonds in polypeptides and proteins. Generally, subtilisin proteases are serine proteases that contain a catalytic triad of the three amino acids aspartate, histidine, and serine. The arrangement of these catalytic residues is shared with the prototypical subtilisin from *Bacillus licheniformis*. Subtilisin proteases from eukaryotic organisms such as *Trichoderma* fungi include furin, MBTPS 1, and TPP2. Eukaryotic trypsin-like serine proteases further include an aspartic acid residue in the oxyanion hole.

Subtilisin Protease Slp7 Resembles Also Sedolisin Protease Tpp1.

Seven subtilisin proteases have been identified in *Trichoderma* fungal cells: slp1 (tre51365); slp1 (tre123244); slp3 (tre123234); slp5 (tre64719), slp6 (tre121495), slp7 (tre123865), and slp8 (tre58698).

Slp1

Examples of suitable slp1 proteases include, without limitation, *Trichoderma reesei* slp1 (SEQ ID NO: 82), *Trichoderma atroviride* jgi|Triat2 (SEQ ID NO: 83), *Trichoderma atroviride* jgi|Triat2 (SEQ ID NO: 84), *Trichoderma virens* jgi|TriviGv29_8_2 (SEQ ID NO: 85), *Hypocrea lixii* gi|145583581 (SEQ ID NO: 86), *Metarhizium acridum* gi|322694632 (SEQ ID NO: 87), *Fusarium oxysporum* gi|342877080 (SEQ ID NO: 88), *Gibberella zeae* gi|46139915 (SEQ ID NO: 89), *Epichloe festucae* gi|170674476 (SEQ ID NO: 90), *Nectria haematococca* gi|302893164 (SEQ ID NO: 91), *Sordaria macrospore* gi|336266150 (SEQ ID NO: 92), *Glomerella graminicola* gi|310797947 (SEQ ID NO: 93), *Neurospora tetrasperma* gi|336469805 (SEQ ID NO: 94), *Neurospora crassa* gi|85086707 (SEQ ID NO: 95), *Magnaporthe oryzae* gi|145608997 (SEQ ID NO: 96), *Chaetomium globosum* gi|116208730 (SEQ ID NO: 97), *M. thermophila* gi367029081 (SEQ ID NO: 539), and homologs thereof.

Accordingly, in certain embodiments, a protease of the present disclosure, typically a slp1 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 82-97, SEQ ID NO:539. In some embodiments, the protease has 100% identity to an amino acid sequence selected from SEQ ID NOs: 82-97, SEQ ID NO:539.

In some embodiments, slp1 is *T. reesei* slp1. The amino acid sequence encoded by *T. reesei* slp1 is set forth in SEQ ID NO: 82. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 82. In further embodiments, the protease has 100% identity to SEQ ID NO: 82.

Slp2

Examples of suitable slp2 proteases include, without limitation, *Trichoderma reesei* slp2 (SEQ ID NO: 98), *T. atroviride* jgi|Triat2 (SEQ ID NO: 99), *T. virens* jgi|TriviGv29_8_2 (SEQ ID NO: 100), *Hypocrea lixii* gi|115111226 (SEQ ID NO: 101), *Aspergillus fumigatus* gi|70997972 (SEQ ID NO: 102), *Nectria haematococca* gi|302915240 (SEQ ID NO: 103), *Gibberella zeae* gi|46105128 (SEQ ID NO: 104), *Isaria farinose* gi|68165000 (SEQ ID NO: 105), *Glomerella graminicola* gi|310797854 (SEQ ID NO: 106), *Epichloe festucae* gi|170674491 (SEQ ID NO: 107), *Metarhizium acridum* gi|322697754 (SEQ ID NO: 108), *Acremonium sp.* F11177 gi|147225254 (SEQ ID NO: 109), *Ophiostoma piliferum* gi|115808807 (SEQ ID NO: 110), *Neurospora tetrasperma* gi|336463649 (SEQ ID NO: 111), *Chaetomium thermophilum* gi|340992600 (SEQ ID NO: 112), *Metarhizium flavoviride* gi|254351265 (SEQ ID NO: 113), *Podospora anserine* gi|171680111 (SEQ ID NO: 114), *Magnaporthe oryzae* gi|39943180 (SEQ ID NO: 115), *Sclerotinia sclerotiorum* gi|156058540 (SEQ ID NO: 116), *Talaromyces stipitatus* gi|242790441 (SEQ ID NO: 117), *M. thermophila* gi367021472 (SEQ ID NO: 540), *A. niger* gi|45237646 (SEQ ID NO: 541), *A. oryzae* gi|69780712 (SEQ ID NO: 542), *P. chrysogenum* gi255955889 (SEQ ID NO: 543), *A. nidulans* gi259489544 (SEQ ID NO: 544), *N. crassa* gi85084841 (SEQ ID NO: 545), and homologs thereof.

Accordingly, in certain embodiments, a protease of the present disclosure, typically a slp2 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 98-117, SEQ ID NOs:540-545. In some embodiments, the protease has 100% identity to an amino acid sequence selected from SEQ ID NOs: 98-117, SEQ ID NOs:540-545.

In some embodiments, slp2 is *T. reesei* slp2. The amino acid sequence encoded by *T. reesei* slp2 is set forth in SEQ ID NO: 98. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 98. In further embodiments, the protease has 100% identity to SEQ ID NO: 98.

Slp3

Examples of suitable slp3 proteases include, without limitation, *Trichoderma reesei* slp2 (SEQ ID NO: 166), *T. atroviride* jgi|Triat2 (SEQ ID NO: 167), *T. virens* jgi|TriviGv29_8_2 (SEQ ID NO: 168), *Hypocrea koningii* gi|124295071 (SEQ ID NO: 169), *Purpureocillium lilacinum* gi|130750164 (SEQ ID NO: 170), *Metarhizium anisopliae* gi|16215677 (SEQ ID NO: 171), *Hirsutella rhossiliensis* gi|90655148 (SEQ ID NO: 172), *Tolypocladium inflation* gi|118542429 (SEQ ID NO: 173), *Metacordyceps chlamydosporia* gi|9171215 (SEQ ID NO: 174), *Cordyceps militaris* gi|346321368 (SEQ ID NO: 175), *Fusarium* sp. gi|628051 (SEQ ID NO: 176), *Neurospora tetrasperma* gi|336471881 (SEQ ID NO: 177), *Chaetomium globosum* gi| 16197403 (SEQ ID NO: 178), *Neurospora crassa* gi|85084841 (SEQ ID NO: 179), *Fusarium oxysporum* gi|56201265 (SEQ ID NO: 180), *Gibberella zeae* gi|46114268 (SEQ ID NO: 181), *M. thermophila* gi367026259 (SEQ ID NO: 546), *A. nidulans* gi67538776 (SEQ ID NO: 547), *A. oryzae* gi69771349 (SEQ ID NO: 222), *A. niger* gi470729 (SEQ ID NO: 223), and homologs thereof.

Accordingly, in certain embodiments, a protease of the present disclosure, typically a slp3 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 166-181, SEQ ID NOs:546-547, SEQ ID NOs:222-223. In some embodiments, the protease has 100% identity to an amino acid sequence selected from SEQ ID NOs: 166-181, SEQ ID NOs: 546-547, SEQ ID NOs: 222-223.

In some embodiments, slp3 is *T. reesei* slp3. The amino acid sequence encoded by *T. reesei* slp3 is set forth in SEQ ID NO: 166. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 166. In further embodiments, the protease has 100% identity to SEQ ID NO: 166.

Slp5

Examples of suitable slp5 proteases include, without limitation, *Trichoderma reesei* slp5 (SEQ ID NO: 200), *T. atroviride* jgi|Triat2 (SEQ ID NO: 201), *T. virens* jgi|TriviGv29_8_2 (SEQ ID NO: 202), *Hypocrea lixii* gi|118161442 (SEQ ID NO: 203), *Fusarium oxysporum* gi|342883549 (SEQ ID NO: 204), *Gibberella zeae* gi|46135733 (SEQ ID NO: 205), *Glomerella graminicola* gi|310796396 (SEQ ID NO: 206), *Nectria haematococca* gi|302927954 (SEQ ID NO: 207), *Cordyceps militaris* gi|346319783 (SEQ ID NO: 208), *Neurospora crassa* gi|85094084 (SEQ ID NO: 209), *Neurospora tetrasperma* gi|336467281 (SEQ ID NO: 210), *Verticillium dahliae* gi|346971706 (SEQ ID NO: 211), *Thielavia terrestris* gi|347001418 (SEQ ID NO: 212), *Magnaporthe oryzae* gi| 145605493 (SEQ ID NO: 213), *M. thermophila* gi367032200 (SEQ ID NO: 548), *P. chrysogenum* gi62816282 (SEQ ID NO: 549), and homologs thereof.

Accordingly, in certain embodiments, a protease of the present disclosure, typically a slp5 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 200-213, SEQ ID NOs:548-549. In some embodiments, the protease has 100% identity to an amino acid sequence selected from SEQ ID NOs: 200-213, SEQ ID NOs:548-549.

In some embodiments, slp5 is *T. reesei* slp5. The amino acid sequence encoded by *T. reesei* slp5 is set forth in SEQ ID NO: 200. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 200. In further embodiments, the protease has 100% identity to SEQ ID NO: 200.

Slp6

Examples of suitable slp6 proteases include, without limitation, *Trichoderma reesei* slp6 (SEQ ID NO: 214), *T. atroviride* jgi|Triat2 (SEQ ID NO: 215), *T. virens* jgi|TriviGv29_8_2 (SEQ ID NO: 216), *Hypocrea virens* gi29421423 (SEQ ID NO: 217), *Hypocrea lixii* gi| 145583127 (SEQ ID NO: 218), *Trichoderma hamatum* gi|30144643 (SEQ ID NO: 219), *Aspergillus fumigatus* gi|2295 (SEQ ID NO: 220), *Aspergillus terreus* gi|115391147 (SEQ ID NO: 221), *Aspergillus oryzae* gi|169771349 (SEQ ID NO: 222), *Aspergillus niger* gi|470729 (SEQ ID NO: 223), *Glomerella graminicola* gi|310794714 (SEQ ID NO: 224), *Gibberella zeae* gi|46114946 (SEQ ID NO: 225), *Fusarium oxysporum* gi|342873942 (SEQ ID NO: 226), *Nectria haematococca* gi|302884541 (SEQ ID NO: 227), *Neosartorya fischeri* gi|119500190 (SEQ ID NO: 228), *Verticillium* alboatrum gi|302413161 (SEQ ID NO: 229), *Glomerella graminicola* gi|310790144 (SEQ ID NO: 230), *N. crassa* gi85090020 (SEQ ID NO: 550), and homologs thereof.

Accordingly, in certain embodiments, a protease of the present disclosure, typically a slp6 protease, has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 214-230, SEQ ID NO:550. In some embodiments, the protease has 100% identity to an amino acid sequence selected from SEQ ID NOs: 214-230, SEQ ID NO:550.

In some embodiments, slp6 is *T. reesei* slp6. The amino acid sequence encoded by *T. reesei* slp6 is set forth in SEQ ID NO: 214. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 214. In further embodiments, the protease has 100% identity to SEQ ID NO: 214.

Slp7

Examples of suitable slp7 proteases include, without limitation, *Trichoderma reesei* slp7 (SEQ ID NO: 231), *T. atroviride* jgi|Triat2 (SEQ ID NO: 232), *T. virens* jgi|TriviGv29_8_2 (SEQ ID NO: 233), *Metarhizium anisopliae* gi|322710320 (SEQ ID NO: 234), *Nectria* haematococca gi|302915000 (SEQ ID NO: 235), *Myceliophthora thermophila* gi|347009020, gi|367024935 (SEQ ID NO: 236), *Gibberella zeae* gi|46137655 (SEQ ID NO: 237), *Thielavia terrestris* gi|346996549 (SEQ ID NO: 238), *Magnaporthe oryzae* gi|l45610733 (SEQ ID NO: 239), *A. nidulans* gi67541991 (SEQ ID NO: 551), *P. chrysogenum* gi255933786 (SEQ ID NO: 552), *A. niger* gi317036543 (SEQ ID NO: 553), *A. oryzae* gi|69782882 (SEQ ID NO: 554), *N. crassa* gi85109979 (SEQ ID NO: 555), and homologs thereof.

Accordingly, in certain embodiments, a protease of the present disclosure, typically a slp7 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 231-239, SEQ ID NOs:551-555. In some embodiments, the protease has 100% identity to an amino acid sequence selected from SEQ ID NOs: 231-239, SEQ ID NOs:551-555.

In some embodiments, slp7 is *T. reesei* slp7. The amino acid sequence encoded by *T. reesei* slp7 is set forth in SEQ ID NO: 231. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 231. In further embodiments, the protease has 100% identity to SEQ ID NO: 231.

Slp8

Examples of suitable slp8 proteases include, without limitation, *Trichoderma reesei* slp8 (SEQ ID NO: 240), *T. atroviride* jgi|Triat2H98568 (SEQ ID NO: 241), *T. virens* jgi|TriviGv29_8_2133902 (SEQ ID NO: 242), and homologs thereof.

Accordingly, in certain embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 240-242. In some embodiments, the protease has 100% identity to an amino acid sequence selected from SEQ ID NOs: 240-242.

In some embodiments, slp8 is *T. reesei* slp8. The amino acid sequence encoded by *T. reesei* slp8 is set forth in SEQ ID NO: 240. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 240. In further embodiments, the protease has 100% identity to SEQ ID NO: 240.

Glutamic Proteases

Glutamic proteases are enzymes that hydrolyze the peptide bonds in polypeptides and proteins. Glutamic proteases are insensitive to pepstatin A, and so are sometimes referred to as pepstatin insensitive acid proteases. While glutamic proteases were previously grouped with the aspartic proteases and often jointly referred to as acid proteases, it has been recently found that glutamic proteases have very different active site residues than aspartic proteases.

Two glutamic proteases have been identified in *Trichoderma* fungal cells: gap1 (tre69555) and gap2 (tre106661).

Gap1

Examples of suitable gap1 proteases include, without limitation, *Trichoderma reesei* gap1 (SEQ ID NO: 118), *T. atroviride* jgi|Triat2140863 (SEQ ID NO: 119), *T. virens* jgi|TriviGv29_8_21 192684 (SEQ ID NO: 120), *Aspergillus flavus* gi|238499183 (SEQ ID NO: 121), *Aspergillus niger* gi|l45251555 (SEQ ID NO: 122), *Aspergillus terreus* gi|115491521 (SEQ ID NO: 123), gi|37154543 (SEQ ID NO: 124), gi|48425531 (SEQ ID NO: 125), gi|351873 (SEQ ID NO: 126), *Thielavia terrestris* gi|346997245 (SEQ ID NO: 127), *Penicillium chrysogenum* gi|255940586 (SEQ ID NO: 128), *M. thermophila* gi367026504 (SEQ ID NO: 574), *A. oryzae* gi317150886 (SEQ ID NO: 575), *N. crassa* gi85097968 (SEQ ID NO: 576), *A. niger* gi31056 (SEQ ID NO: 577), *P. chrysogenum* gi255930123 (SEQ ID NO: 578), *A. niger* gi|45236956 (SEQ ID NO: 579), *A. oryzae* gi|69772955 (SEQ ID NO: 580), *A. niger* gi|45249222 (SEQ ID NO: 581), *A. nidulans* gi67525839 (SEQ ID NO: 582), *A. oryzae* gi|69785367 (SEQ ID NO: 583), *P. chrysogenum* gi255955319 (SEQ ID NO: 584), *M. thermophila* gi367019352 (SEQ ID NO: 585), *A oryzae* gi391863974 (SEQ ID NO: 586), *M. thermophila* gi367024513 (SEQ ID NO: 587), and homologs thereof.

Accordingly, in certain embodiments, a protease of the present disclosure, typically a gap1 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 118-128, SEQ ID NOs:574-587. In some embodiments, the protease has 100% identity to an amino acid sequence selected from SEQ ID NOs: 118-128, SEQ ID NOs:574-587.

In some embodiments, gap1 is *T. reesei* gap1. The amino acid sequence encoded by *T. reesei* gap1 is set forth in SEQ ID NO: 118. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 118. In further embodiments, the protease has 100% identity to SEQ ID NO: 118.

Gap2

Examples of suitable gap2 proteases include, without limitation, *Trichoderma reesei* gap2 (SEQ ID NO: 129), *T. atroviride* jgi|Triat21298116 (SEQ ID NO: 130), *T. virens* jgi|TriviGv29_8_2130331 (SEQ ID NO: 131), jgi|TriviGv29_8_21225131 (SEQ ID NO: 132), *Aspergillus flavus* gi|238499183 (SEQ ID NO: 133), *Aspergillus niger* gi|145251555 (SEQ ID NO: 134), *Aspergillus nidulans* gi|67901056 (SEQ ID NO: 135), *Aspergillus clavatus* gi|121711990 (SEQ ID NO: 136), *Aspergillus fumigatus* gi|70986250 (SEQ ID NO: 137), *Penicillium marneffei* gi|212534108 (SEQ ID NO: 138), *Talaromyces stipitatus* gi|242789335 (SEQ ID NO: 139), *Grosmannia clavigera* gi|320591529 (SEQ ID NO: 140), *Neosartorya fischeri* gi|119474281 (SEQ ID NO: 141), *Penicillium marneffei* gi|212527274 (SEQ ID NO: 142), *Penicillium chrysogenum* gi|255940586 (SEQ ID NO: 143), gi|131056 (SEQ ID NO: 144), *M. thermophila* gi367030275 (SEQ ID NO: 588), and homologs thereof.

Accordingly, in certain embodiments, a protease of the present disclosure, typically a gap2 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 129-144, SEQ ID NO:588. In some embodiments, the protease has 100% identity to an amino acid sequence selected from SEQ ID NOs: 129-144, SEQ ID NO:588.

In some embodiments, gap2 is *T. reesei* gap2. The amino acid sequence encoded by *T. reesei* gap2 is set forth in SEQ ID NO: 129. In other embodiments, a protease of the present disclosure has an amino acid sequence having 50% or more identity (e.g. 60%, 65%, 70%, 75%, 80%, 85%, 90%, 91%, 92%, 93%, 94%, 95%, 96%, 97%, 98%, 99%, 99.5% or more) to SEQ ID NO: 129. In further embodiments, the protease has 100% identity to SEQ ID NO: 129.

Sedolisin Proteases

Sedolisin proteases are enzymes that use a serine residue for hydrolysis of the peptide bonds in polypeptides and proteins. Sedolisin proteases generally contain a unique catalytic triad of serine, glutamate, and aspartate. Sedolisin proteases also contain an aspartate residue in the oxyanion hole. Sedolisin proteases from eukaryotic organisms such as *Trichoderma* fungi include tripeptidyl peptidase.

Examples of suitable tpp1 proteases include, without limitation, *Trichoderma reesei* tpp1 (SEQ ID NO: 145), *T. atroviride* jgi|Triat2H88756 (SEQ ID NO: 146), *T. virens* jgi|TriviGv29_8_21217176 (SEQ ID NO: 147), *Aspergillus fumigatus* gi|70993168 (SEQ ID NO: 148), *Aspergillus oryzae* gi|169776800 (SEQ ID NO: 149), *Aspergillus niger* gi|145236399 (SEQ ID NO: 150), *Aspergillus clavatus* gi|121708799 (SEQ ID NO: 151), *Aspergillus niger* gi|145239871 (SEQ ID NO: 152), *Aspergillus clavatus* gi|121714541 (SEQ ID NO: 153), *Aspergillus terreus* gi|115387645 (SEQ ID NO: 154), *Aspergillus fumigatus* gi|70982015 (SEQ ID NO: 155), *Sclerotinia sclerotiorum* gi|156045898 (SEQ ID NO: 156), *Botryotinia juckeliana* gi|154321758 (SEQ ID NO: 157), *Neosartorya fischeri* gi|119499774 (SEQ ID NO: 158), *Talaromyces stipitatus* gi|242798348 (SEQ ID NO: 159), *Penicillium marneffei* gi|212541546 (SEQ ID NO: 160), *Gibberella zeae* gi|46114460 (SEQ ID NO: 161), *Fusarium oxysporum* gi|342890694 (SEQ ID NO: 162), *Grosmannia clavigera* gi|320592937 (SEQ ID NO: 163), *Verticillium alboatrum* gi|302406186 (SEQ ID NO: 164), *Verticillium dahliae* gi|346971444 (SEQ ID NO: 165), *A. fumigatus* CAE51075.1 (SEQ ID NO: 556), *A. oryzae* XP_001820835.1 (SEQ ID NO: 557), *P. chrysogenum* XP_002564029.1 (SEQ ID NO: 558), *A. nidulans* XP_664805.1 (SEQ ID NO: 559), *P. chrysogenum* XP_002565814.1 (SEQ ID NO: 560), *M. thermophila* XP_003663689.1 (SEQ ID NO: 561), *N. crassa* XP_958412.1 (SEQ ID NO: 562), *A. niger* XP_001394118.1 (SEQ ID NO: 563), *A. fumigatus* CAE17674.1 (SEQ ID NO: 564), *A. niger* XP_001400873.1 (SEQ ID NO: 565), *A. fumigatus* CAE46473.1 (SEQ ID NO: 566), *A. oryzae* XP_002373530.1 (SEQ ID NO: 567), *A. nidulans* XP_660624.1 (SEQ ID NO: 568), *P. chrysogenum* XP_002562943.1 (SEQ ID NO: 569), *A. fumigatus* CAE17675.1 (SEQ ID NO: 570), *A. fumigatus* EAL86850.2 (SEQ ID NO: 571), *N. crassa* XP_961957.1 (SEQ ID NO: 572), *A. oryzae* BAB97387.1 (SEQ ID NO: 573), and homologs thereof.

Accordingly, in certain embodiments, a protease of the present disclosure, typically a tpp1 protease, has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more to an amino acid sequence selected from SEQ ID NOs: 145-165, SEQ ID NOs:556-573. In some embodiments, the protease has 100% identity to an amino acid sequence selected from SEQ ID NOs: 145-165, SEQ ID NOs:556-573.

In some embodiments, tpp1 is *T. reesei* tpp1. The amino acid sequence encoded by *T. reesei* tpp1 is set forth in SEQ ID NO: 145. In other embodiments, a protease of the present disclosure has an amino acid sequence having 50% or more identity {e.g. 60%, 65%, 70%, 75%, 80%, 85%, 90%, 91%, 92%, 93%, 94%, 95%, 96%, 97%, 98%, 99%, 99.5% or more) to SEQ ID NO: 145. In further embodiments, the protease has 100% identity to SEQ ID NO: 145.

Homologous Proteases

Other embodiments of the present disclosure relate to reducing the activity of proteases that are homologous to the proteases of the present disclosure. "Homology" as used herein refers to sequence similarity between a reference sequence and at least a fragment of a second sequence. Homologs may be identified by any method known in the art, preferably, by using the BLAST tool to compare a reference sequence to a single second sequence or fragment of a sequence or to a database of sequences. As described below, BLAST will compare sequences based upon percent identity and similarity.

The terms "identical" or percent "identity," in the context of two or more nucleic acid or amino acid sequences, refers to two or more sequences or subsequences that are the same. Two sequences are "substantially identical" if two sequences have a specified percentage of amino acid residues or nucleotides that are the same (i.e., 29% identity, optionally 30%, 40%, 45%, 50%, 55%, 60%, 65%, 70%, 75%, 80%, 85%, 90%, 95%, 99% or 100% identity over a specified region, or, when not specified, over the entire sequence), when compared and aligned for maximum correspondence over a comparison window, or designated region as measured using one of the following sequence comparison algorithms or by manual alignment and visual inspection. Optionally, the identity exists over a region that is at least about 50 nucleotides (or 10 amino acids) in length, or more preferably over a region that is 100 to 500 or 1000 or more nucleotides (or 20, 50, 200, or more amino acids) in length.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. When comparing two sequences for identity, it is not necessary that the sequences be contiguous, but any gap would carry with it a penalty that would reduce the overall percent identity. For blastn, the default parameters are Gap opening penalty=5 and Gap extension penalty=2. For blastp, the default parameters are Gap opening penalty=11 and Gap extension penalty=1.

A "comparison window," as used herein, includes reference to a segment of any one of the number of contiguous positions including, but not limited to from 20 to 600, usually about 50 to about 200, more usually about 100 to about 150 in which a sequence may be compared to a reference sequence of the same number of contiguous positions after the two sequences are optimally aligned. Methods of alignment of sequences for comparison are well known in the art. Optimal alignment of sequences for comparison can be conducted, e.g., by the local homology algorithm of Smith and Waterman (1981), by the homology alignment algorithm of Needleman and Wunsch (1970) J Mol Biol 48(3):443-453, by the search for similarity method of Pearson and Lipman (1988) Proc Natl Acad Sci USA 85(8): 2444-2448, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection [see, e.g., Brent et al., (2003) Current Protocols in Molecular Biology, John Wiley & Sons, Inc. (Ringbou Ed)].

Two examples of algorithms that are suitable for determining percent sequence identity and sequence similarity are the BLAST and BLAST 2.0 algorithms, which are described in Altschul et al. (1997) Nucleic Acids Res 25(17): 3389-3402 and Altschul et al. (1990) J. Mol Biol 215(3)-403-410, respectively. Software for performing BLAST analyses is publicly available through the National Center for Biotechnology Information. This algorithm involves first identifying high scoring sequence pairs (HSPs) by identifying short words of length W in the query sequence, which either match or satisfy some positive-valued threshold score T when aligned with a word of the same length in a database sequence. T is referred to as the neighborhood word score threshold (Altschul et al., supra). These initial neighborhood word hits act as seeds for initiating searches to find longer HSPs containing them. The word hits are extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) or 10, M=5, N=−4, and a comparison of both strands. For amino acid sequences, the BLASTP program uses as defaults a wordlength of 3, and expectation (E) of 10, and the BLOSUM62 scoring matrix [see Henikoff and Henikoff, (1992) Proc Natl Acad Sci USA 89(22): 10915-10919] alignments (B) of 50, expectation (E) of 10, M=5, N=−4, and a comparison of both strands.

The BLAST algorithm also performs a statistical analysis of the similarity between two sequences (see, e.g., Karlin and Altschul, (1993) Proc Natl Acad Sci USA 90(12):5873-5877). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.2, more preferably less than about 0.01, and most preferably less than about 0.001.

Other than percentage of sequence identity noted above, another indication that two nucleic acid sequences or polypeptides are substantially identical is that the polypeptide encoded by the first nucleic acid is immunologically cross-reactive with the antibodies raised against the polypeptide encoded by the second nucleic acid, as described below. Thus, a polypeptide is typically substantially identical to a second polypeptide, for example, where the two peptides differ only by conservative substitutions. Another indication that two nucleic acid sequences are substantially identical is that the two molecules or their complements hybridize to each other under stringent conditions, as described below. Yet another indication that two nucleic acid sequences are substantially identical is that the same primers can be used to amplify the sequence.

As disclosed herein, proteases of the present disclosure may also include proteases that are conservatively modified variants of proteases encoded by the protease genes disclosed above. "Conservatively modified variants" as used herein include individual substitutions, deletions or additions to an encoded amino acid sequence which result in the substitution of an amino acid with a chemically similar amino acid. Conservative substitution tables providing functionally similar amino acids are well known in the art. Such conservatively modified variants are in addition to and do not exclude polymorphic variants, interspecies homologs, and alleles of the disclosure. The following eight groups contain amino acids that are conservative substitutions for one another: 1) Alanine (A), Glycine (G); 2) Aspartic acid (D), Glutamic acid (E); 3) Asparagine (N), Glutamine (Q); 4) Arginine (R), Lysine (K); 5) Isoleucine (I), Leucine (L), Methionine (M), Valine (V); 6) Phenylalanine (F), Tyrosine (Y), Tryptophan (W); 7) Serine (S), Threonine (T); and 8) Cysteine (C), Methionine (M) (see, e.g., Creighton, Proteins (1984)).

FIGS. 45-48 depicts phylogenetic trees of aspartic, subtilisin, glutamic and sedolisin proteases of selected filamentous fungi.

Methods of Reducing the Activity of Proteases of the Invention

Further aspects of the present disclosure relate to reducing the activity of proteases found in filamentous fungal cells that express a heterologous polypeptide, such a mammalian polypeptide.

The activity of proteases found in filamentous fungal cells can be reduced by any method known to those of skill in the art.

In some embodiments reduced activity of proteases is achieved by reducing the expression of the protease, for example, by promoter modification or RNAi.

In other embodiments, reduced activity of proteases is achieved by modifying the gene encoding the protease. Examples of such modifications include, without limitation, a knock-out mutation, a truncation mutation, a point mutation, a missense mutation, a substitution mutation, a frame-shift mutation, an insertion mutation, a duplication mutation, an amplification mutation, a translocation mutation, or an inversion mutation, and that results in a reduction in the corresponding protease activity. Methods of generating at least one mutation in a protease encoding gene of interest are well known in the art and include, without limitation, random mutagenesis and screening, site-directed mutagenesis, PCR mutagenesis, insertional mutagenesis, chemical mutagenesis, and irradiation.

In certain embodiments, a portion of the protease encoding gene is modified, such as the region encoding the catalytic domain, the coding region, or a control sequence required for expression of the coding region. Such a control sequence of the gene may be a promoter sequence or a functional part thereof, i.e., a part that is sufficient for affecting expression of the gene. For example, a promoter sequence may be inactivated resulting in no expression or a weaker promoter may be substituted for the native promoter sequence to reduce expression of the coding sequence. Other control sequences for possible modification include, without limitation, a leader sequence, a propeptide sequence, a signal sequence, a transcription terminator, and a transcriptional activator.

Protease encoding genes of the present disclosure that are present in filamentous fungal cells that express a recombinant polypeptide may also be modified by utilizing gene deletion techniques to eliminate or reduce expression of the gene. Gene deletion techniques enable the partial or complete removal of the gene thereby eliminating their expression. In such methods, deletion of the gene may be accomplished by homologous recombination using a plasmid that has been constructed to contiguously contain the 5' and 3' regions flanking the gene.

The protease encoding genes of the present disclosure that are present in filamentous fungal cells that express a recombinant polypeptide may also be modified by introducing, substituting, and/or removing one or more nucleotides in the gene, or a control sequence thereof required for the transcription or translation of the gene. For example, nucleotides may be inserted or removed for the introduction of a stop codon, the removal of the start codon, or a frame-shift of the open reading frame. Such a modification may be accomplished by methods known in the art, including without limitation, site-directed mutagenesis and peR generated mutagenesis (see, for example, Botstein and Shortie, 1985, Science 229: 4719; Lo et al., 1985, Proceedings of the National Academy of Sciences USA 81: 2285; Higuchi et al., 1988, Nucleic Acids Research 16: 7351; Shimada, 1996, Meth. Mol. Bioi. 57: 157; Ho et al., 1989, Gene 77: 61; Horton et al., 1989, Gene 77: 61; and Sarkar and Sommer, 1990, BioTechniques 8: 404).

Additionally, protease encoding genes of the present disclosure that are present in filamentous fungal cells that express a recombinant polypeptide may be modified by gene disruption techniques by inserting into the gene a disruptive nucleic acid construct containing a nucleic acid fragment homologous to the gene that will create a duplication of the region of homology and incorporate construct DNA between the duplicated regions. Such a gene disruption can eliminate gene expression if the inserted construct separates the promoter of the gene from the coding region or interrupts the coding sequence such that a nonfunctional gene product results. A disrupting construct may be simply a selectable marker gene accompanied by 5' and 3' regions homologous to the gene. The selectable marker enables identification of transformants containing the disrupted gene.

Protease encoding genes of the present disclosure that are present in filamentous fungal cells that express a recombinant polypeptide may also be modified by the process of gene conversion (see, for example, Iglesias and Trautner, 1983, Molecular General Genetics 189:5 73-76). For example, in the gene conversion a nucleotide sequence corresponding to the gene is mutagenized in vitro to produce a defective nucleotide sequence, which is then transformed into a Trichoderma strain to produce a defective gene. By homologous recombination, the defective nucleotide sequence replaces the endogenous gene. It may be desirable that the defective nucleotide sequence also contains a marker for selection of transformants containing the defective gene.

Protease encoding genes of the present disclosure that are present in filamentous fungal cells that express a recombinant polypeptide may also be modified by established anti-sense techniques using a nucleotide sequence complementary to the nucleotide sequence of the gene (see, for example, Parish and Stoker, 1997, FEMS Microbiology Letters 154: 151-157). In particular, expression of the gene by filamentous fungal cells may be reduced or inactivated by introducing a nucleotide sequence complementary to the nucleotide sequence of the gene, which may be transcribed in the strain and is capable of hybridizing to the mRNA produced in the cells. Under conditions allowing the complementary anti-sense nucleotide sequence to hybridize to the mRNA, the amount of protein translated is thus reduced or eliminated.

In addition, protease encoding genes of the present disclosure that are present in filamentous fungal cells that express a recombinant polypeptide may also be modified by established RNA interference (RNAi) techniques (see, for example, WO 2005/056772 and WO 2008/080017).

Protease encoding genes of the present disclosure that are present in filamentous fungal cells that express a recombinant polypeptide may also be modified by random or specific mutagenesis using methods well known in the art, including without limitation, chemical mutagenesis (see, for example, Hopwood, The Isolation of Mutants in Methods in Microbiology (J. R. Norris and D. W. Ribbons, eds.) pp. 363-433, Academic Press, New York, 25 1970). Modification of the gene may be performed by subjecting filamentous fungal cells to mutagenesis and screening for mutant cells in which expression of the gene has been reduced or inactivated. The mutagenesis, which may be specific or random, may be performed, for example, by use of a suitable physical or chemical mutagenizing agent, use of a suitable oligonucleotide, subjecting the DNA sequence to peR generated mutagenesis, or any combination thereof. Examples of physical and chemical mutagenizing agents include, without limitation, ultraviolet (UV) irradiation, hydroxylamine, N-methyl-N'-nitro-N-nitrosoguanidine (MNNG), N-methyl-N'-nitrosogaunidine (NTG) O-methyl hydroxylamine, nitrous acid, ethyl methane sulphonate (EMS), sodium bisulphite, formic acid, and nucleotide analogues. When such agents are used, the mutagenesis is typically performed by incubating the *Trichoderma* cells to be mutagenized in the presence of the mutagenizing agent of choice under suitable conditions, and then selecting for mutants exhibiting reduced or no expression of the gene.

In certain embodiments, the at least one mutation or modification in a protease encoding gene of the present disclosure results in a modified protease that has no detectable protease activity. In other embodiments, the at least one modification in a protease encoding gene of the present disclosure results in a modified protease that has at least 25% less, at least 50% less, at least 75% less, at least 90%, at least 95%, at least 100%, at least 200%, at least 300%, at least 400%, at least 500%, at least 600%, at least 700%, at least 800%, at least 900%, at least 1,000%, or a higher percentage less protease activity compared to a corresponding non-modified protease.

In certain embodiments, for example, in a *Trichoderma* cell, the at least one mutation or modification in a protease encoding gene of the present disclosure results in a reduction of total protease activity to 49% or less, typically with a mutation in at least 2 distinct protease genes, or 31% or less, typically with a mutation in at least 3 distinct protease genes, or 13% or less, typically with a mutation in at least 4 distinct protease genes, or 10% or less, typically with a mutation in at least 5 distinct protease genes, or 6.3% or less, typically with a mutation in at least 6 distinct protease genes, or 5.5% or less, typically with a mutation in at least 7 distinct protease genes, of the total protease activity of the corresponding parental *Trichoderma* cell.

Heterologous Polypeptides of the Invention

The invention herein further relates to increasing the production of heterologous polypeptides in filamentous fungal cells that express such heterologous polypeptides by reducing the activity of proteases found in the cells.

As used herein a "heterologous polypeptide" refers to a polypeptide that is not naturally found in (i.e., endogenous) a filamentous fungal cell of the present disclosure, or that is expressed at an elevated level in a filamentous fungal cell as compared to the endogenous version of the polypeptide. In certain embodiments, the heterologous polypeptide is a mammalian polypeptide. In other embodiments, the heterologous polypeptide is a non-mammalian polypeptide.

Mammalian Polypeptides

Mammalian polypeptides of the present disclosure may be any mammalian polypeptide having a biological activity of interest. As used herein, a "mammalian polypeptide" is a polypeptide that is natively expressed in a mammal, a polypeptide that is derived from a polypeptide that is natively expressed in a mammal, or a fragment thereof. A mammalian polypeptide also includes peptides and oligopeptides that retain biological activity. Mammalian polypeptides of the present disclosure may also include two or more polypeptides that are combined to form the encoded product. Mammalian polypeptides of the present disclosure may further include fusion polypeptides, which contain a combination of partial or complete amino acid sequences obtained from at least two different polypeptides. Mammalian polypeptides may also include naturally occurring allelic and engineered variations of any of the disclosed mammalian polypeptides and hybrid mammalian polypeptides.

The mammalian polypeptide may be a naturally glycosylated polypeptide or a naturally non-glycosylated polypeptide.

Examples of suitable mammalian polypeptides include, without limitation, immunoglobulins, antibodies, antigens, antimicrobial peptides, enzymes, growth factors, hormones, interferons, cytokines, interleukins, immunodilators, neurotransmitters, receptors, reporter proteins, structural proteins, and transcription factors.

Specific examples of suitable mammalian polypeptides include, without limitation, immunoglobulins, immunoglobulin heavy chains, immunoglobulin light chains, monoclonal antibodies, hybrid antibodies, F(ab')2 antibody fragments, F(ab) antibody fragments, Fv molecules, single-chain Fv antibodies, dimeric antibody fragments, trimeric antibody fragments, functional antibody fragments, immunoadhesins, insulin-like growth factor 1, growth hormone, insulin, interferon alpha 2b, fibroblast growth factor 21, human serum albumin, camelid antibodies and/or antibody fragments, single domain antibodies, multimeric single domain antibodies, and erythropoietin.

Other examples of suitable mammalian proteins include, without limitation, an oxidoreductase, a transferase, a hydrolase, a lyase, an isomerase, a ligase, an aminopeptidase, an amylase, a carbohydrase, a carboxypeptidase, a catalase, a glycosyltransferase, a deoxyribonuclease, an esterase, a galactosidase, a betagalactosidase, a glucosidase, a glucuronidase, a glucuronoyl esterase, a haloperoxidase, an invertase, a lipase, an oxidase, a phospholipase, a proteolytic enzyme, a ribonuclease, a urokinase, an albumin, a collagen, a tropoelastin, and an elastin.

Non-Mammalian Polypeptides

Non-mammalian polypeptides of the present disclosure may be any non-mammalian polypeptide having a biological activity of interest. As used herein, a "non-mammalian polypeptide" is a polypeptide that is natively expressed in a non-mammalian organism, such as a fungal cell, a polypeptide that is derived from a polypeptide that is natively expressed in a non-mammal organism, or a fragment thereof. A non-mammalian polypeptide also includes peptides and oligopeptides that retain biological activity. Non-mammalian polypeptides of the present disclosure may also include two or more polypeptides that are combined to form the encoded product. Non-mammalian polypeptides of the present disclosure may further include fusion polypeptides, which contain a combination of partial or complete amino acid sequences obtained from at least two different polypeptides. Non-mammalian polypeptides may also include naturally occurring allelic and engineered variations of any of the disclosed non-mammalian polypeptides and hybrid non-mammalian polypeptides.

Examples of suitable non-mammalian polypeptides include, without limitation, aminopeptidases, amylases, carbohydrases, carboxypeptidases, catalases, cellulases, chitinases, cutinases, deoxyribonucleases, esterases, alpha-galactosidases, beta-galactosidases, glucoamylases, alpha-glucosidases, beta-glucosidases, invertases, laccases, lipases, mutanases, oxidases, pectinolytic enzymes, peroxidases, phospholipases, phytases, polyphenoloxidases, proteolytic enzymes, ribonucleases, transglutaminases and xylanases.

Heterologous Polypeptide Production

A heterologous polypeptide of interest is produced by filamentous fungal cells of the present disclosure containing at least three proteases having reduced activity by cultivating the cells in a nutrient medium for production of the heterologous polypeptide using methods known in the art. For example, the cells may be cultivated by shake flask cultivation, small-scale or large-scale fermentation (including continuous, batch, fed-batch, or solid state fermentations) in laboratory or industrial fermentors performed in a suitable medium and under conditions allowing the polypeptide to be expressed and/or isolated. The cultivation takes place in a suitable nutrient medium comprising carbon and nitrogen sources and inorganic salts, using procedures known in the art. Suitable media are available from commercial suppliers or may be prepared according to published compositions (e.g., in catalogues of the American Type Culture Collection). The secreted polypeptide can be recovered directly from the medium. If the polypeptide is not secreted, it may be obtained from cell lysates.

A heterologous polypeptide of interest produced by a filamentous fungal cell of the present disclosure containing at least three proteases having reduced activity may be detected using methods known in the art that are specific for the heterologous polypeptide. These detection methods may include, without limitation, use of specific antibodies, high performance liquid chromatography, capillary chromatography, formation of an enzyme product, disappearance of an enzyme substrate, and SDS-PAGE. For example, an enzyme assay may be used to determine the activity of an enzyme. Procedures for determining enzyme activity are known in the art for many enzymes (see, for example, O. Schomburg and M. Salzmann (eds.), Enzyme Handbook, Springer-Verlag, New York, 1990).

The resulting heterologous polypeptide may be isolated by methods known in the art. For example, a heterologous polypeptide of interest may be isolated from the cultivation medium by conventional procedures including, without limitation, centrifugation, filtration, extraction, spray-drying, evaporation, and precipitation. The isolated heterologous polypeptide may then be further purified by a variety of procedures known in the art including, without limitation, chromatography (e.g., ion exchange, affinity, hydrophobic, chromatofocusing, and size exclusion), electrophoretic procedures (e.g., preparative isoelectric focusing (IEF), differential solubility (e.g., ammonium sulfate precipitation), or extraction (see, for example, Protein Purification, J.-C. Janson and Lars Ryden, editors, VCH Publishers, New York, 1989).

Preparation of Polynucleotides Encoding Heterologous Polypeptides

Sequences of the heterologous polynucleotides of the present disclosure are prepared by any suitable method known in the art, including, without limitation, direct chemical synthesis or cloning. For direct chemical synthesis, formation of a polymer of nucleic acids typically involves sequential addition of 3'-blocked and 5'-blocked nucleotide monomers to the terminal 5'-hydroxyl group of a growing nucleotide chain, wherein each addition is effected by nucleophilic attack of the terminal 5'-hydroxyl group of the growing chain on the 3'-position of the added monomer, which is typically a phosphorus derivative, such as a phosphotriester, phosphoramidite, or the like. Such methodology is known to those of ordinary skill in the art and is described in the pertinent texts and literature [e.g., in Matteucci et al., (1980) Tetrahedron Lett 21:719-722; U.S. Pat. Nos. 4,500,707; 5,436,327; and 5,700,637]. In addition, the desired sequences may be isolated from natural sources by splitting DNA using appropriate restriction enzymes, separating the fragments using gel electrophoresis, and thereafter, recovering the desired nucleic acid sequence from the gel via techniques known to those of ordinary skill in the art, such as utilization of polymerase chain reactions (PCR; e.g., U.S. Pat. No. 4,683,195).

Each heterologous polynucleotide of the present disclosure can be incorporated into an expression vector. "Expression vector" or "vector" refers to a compound and/or composition that transduces, transforms, or infects a host cell, thereby causing the cell to express nucleic acids and/or proteins other than those native to the cell, or in a manner not native to the cell. An "expression vector" contains a sequence of nucleic acids (ordinarily RNA or DNA) to be expressed by the host cell. Optionally, the expression vector also includes materials to aid in achieving entry of the nucleic acid into the host cell, such as a virus, liposome, protein coating, or the like. The expression vectors contemplated for use in the present disclosure include those into which a nucleic acid sequence can be inserted, along with any preferred or required operational elements. Further, the expression vector must be one that can be transferred into a host cell and replicated therein. Preferred expression vectors are plasmids, particularly those with restriction sites that have been well documented and that contain the operational elements preferred or required for transcription of the nucleic acid sequence. Such plasmids, as well as other expression vectors, are well known in the art.

Incorporation of the individual polynucleotides may be accomplished through known methods that include, for example, the use of restriction enzymes (such as BamHI, EcoRI, HhaI, XhoI, XmaI, and so forth) to cleave specific sites in the expression vector, e.g., plasmid. The restriction enzyme produces single stranded ends that may be annealed to a polynucleotide having, or synthesized to have, a terminus with a sequence complementary to the ends of the cleaved expression vector. Annealing is performed using an appropriate enzyme, e.g., DNA ligase. As will be appreciated by those of ordinary skill in the art, both the expression vector and the desired polynucleotide are often cleaved with the same restriction enzyme, thereby assuring that the ends of the expression vector and the ends of the polynucleotide are complementary to each other. In addition, DNA linkers may be used to facilitate linking of nucleic acids sequences into an expression vector.

A series of individual polynucleotides can also be combined by utilizing methods that are known in the art (e.g., U.S. Pat. No. 4,683,195).

For example, each of the desired polynucleotides can be initially generated in a separate PCR. Thereafter, specific primers are designed such that the ends of the PCR products contain complementary sequences. When the PCR products are mixed, denatured, and reannealed, the strands having the matching sequences at their 3' ends overlap and can act as primers for each other. Extension of this overlap by DNA polymerase produces a molecule in which the original sequences are "spliced" together. In this way, a series of individual polynucleotides may be "spliced" together and subsequently transduced into a host cell simultaneously. Thus, expression of each of the plurality of polynucleotides is affected.

Individual polynucleotides, or "spliced" polynucleotides, are then incorporated into an expression vector. The present disclosure is not limited with respect to the process by which the polynucleotide is incorporated into the expression vector. Those of ordinary skill in the art are familiar with the necessary steps for incorporating a polynucleotide into an expression vector. A typical expression vector contains the desired polynucleotide preceded by one or more regulatory regions, along with a ribosome binding site, e.g., a nucleotide sequence that is 3-9 nucleotides in length and located 3-11 nucleotides upstream of the initiation codon in E. coli. See Shine and Dalgarno (1975) Nature 254(5495):34-38 and Steitz (1979) Biological Regulation and Development (ed. Goldberger, R. R), 1:349-399 (Plenum, N.Y.).

The term "operably linked" as used herein refers to a configuration in which a control sequence is placed at an appropriate position relative to the coding sequence of the DNA sequence or polynucleotide such that the control sequence directs the expression of a polypeptide.

Regulatory regions include, for example, those regions that contain a promoter and an operator. A promoter is operably linked to the desired polynucleotide, thereby initiating transcription of the polynucleotide via an RNA polymerase enzyme. An operator is a sequence of nucleic acids adjacent to the promoter, which contains a protein-binding domain where a repressor protein can bind. In the absence of a repressor protein, transcription initiates through the promoter. When present, the repressor protein specific to the protein-binding domain of the operator binds to the operator, thereby inhibiting transcription. In this way, control of transcription is accomplished, based upon the particular regulatory regions used and the presence or absence of the corresponding repressor protein. Examples include lactose promoters (LacI repressor protein changes conformation when contacted with lactose, thereby preventing the LacI repressor protein from binding to the operator) and tryptophan promoters (when complexed with tryptophan, TrpR repressor protein has a conformation that binds the operator; in the absence of tryptophan, the TrpR repressor protein has a conformation that does not bind to the operator). Another example is the tac promoter (see de Boer et al., (1983) Proc Natl Acad Sci USA 80(1):21-25). As will be appreciated by those of ordinary skill in the art, these and other expression vectors may be used in the present disclosure, and the present disclosure is not limited in this respect.

Although any suitable expression vector may be used to incorporate the desired sequences, readily available expression vectors include, without limitation: plasmids, such as pSClO1, pBR322, pBBR1MCS-3, pUR, pEX, pMRlOO, pCR4, pBAD24, pUC19, pRS426; and bacteriophages, such as M1 3 phage and λ phage. Of course, such expression vectors may only be suitable for particular host cells. One of ordinary skill in the art, however, can readily determine through routine experimentation whether any particular expression vector is suited for any given host cell. For example, the expression vector can be introduced into the host cell, which is then monitored for viability and expression of the sequences contained in the vector. In addition, reference may be made to the relevant texts and literature, which describe expression vectors and their suitability to any particular host cell.

Suitable expression vectors for the purposes of the invention, including the expression of the desired heterologous polypeptide, enzyme, and one or more catalytic domains described herein, include expression vectors containing the polynucleotide encoding the desired heterologous polypeptide, enzyme, or catalytic domain(s) operably linked to a constitutive or an inducible promoter. Examples of particularly suitable promoters for operable linkage to such polynucleotides include promoters from the following genes: gpdA, cbh1, *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* glucoamylase (glaA), *Aspergillus awamori* glaA, *Rhizomucor miehei* lipase, *Aspergillus oryzae* alkaline protease, *Aspergillus oryzae* triose phosphate isomerase, *Aspergillus nidulans* acetamidase, *Aspergillus oryzae* acetamidase, *Fusarium oxysporum* trypsin-like protease, fungal endo α-L-arabinase (abnA), fungal α-L-arabinofuranosidase A (abfA), fungal α-L-arabinofuranosidase B (abfB), fungal xylanase (xlnA), fungal phytase, fungal ATP-synthetase, fungal subunit 9 (oliC), fungal triose phosphate isomerase (tpi), fungal alcohol dehydrogenase (adhA), fungal α-amylase (amy), fungal amyloglucosidase (glaA), fungal acetamidase (amdS), fungal glyceraldehyde-3-phosphate dehydrogenase (gpd), yeast alcohol dehydrogenase, yeast lactase, yeast 3-phosphoglycerate kinase, yeast triosephosphate isomerase, bacterial a-amylase, bacterial Spo2, and SSO. Examples of such suitable expression vectors and promoters are also described in PCT/EP2011/070956, the entire contents of which is hereby incorporated by reference herein.

Pharmaceutical Compositions Containing Heterologous Polypeptides Produced by Filamentous Fungal Cells of the Invention In another aspect, the present invention provides a composition, e.g., a pharmaceutical composition, containing one or more heterologous polypeptides of interest, such as mammalian polypeptides, produced by the filamentous fungal cells of the present disclosure having reduced activity of at least three proteases and further containing a recombinant polynucleotide encoding the heterologous polypeptide, formulated together with a pharmaceutically acceptable carrier. Pharmaceutical compositions of the invention also can be administered in combination therapy, i.e., combined with other agents. For example, the combination therapy can include a mammalian polypeptide of interest combined with at least one other therapeutic agent.

As used herein, "pharmaceutically acceptable carrier" includes any and all solvents, dispersion media, coatings, antibacterial and antifungal agents, isotonic and absorption delaying agents, and the like that are physiologically compatible. Preferably, the carrier is suitable for intravenous, intramuscular, subcutaneous, parenteral, spinal or epidermal administration (e.g., by injection or infusion). Depending on the route of administration, the active compound, i.e., the mammalian polypeptide of interest, may be coated in a material to protect the compound from the action of acids and other natural conditions that may inactivate the compound.

The pharmaceutical compositions of the invention may include one or more pharmaceutically acceptable salts. A "pharmaceutically acceptable salt" refers to a salt that retains the desired biological activity of the parent compound and does not impart any undesired toxicological effects (see e.g., Berge, S. M., et al. (1977) J. Pharm. Sci. 66: 1-19). Examples of such salts include acid addition salts and base addition salts. Acid addition salts include those derived from nontoxic inorganic acids, such as hydrochloric, nitric, phosphoric, sulfuric, hydrobromic, hydroiodic, phosphorous and the like, as well as from nontoxic organic acids such as aliphatic mono- and dicarboxylic acids, phenyl-substituted alkanoic acids, hydroxy alkanoic acids, aromatic acids, aliphatic and aromatic sulfonic acids and the like. Base addition salts include those derived from alkaline earth metals, such as sodium, potassium, magnesium, calcium and the like, as well as from nontoxic organic amines, such as N,N'-dibenzylethylenediamine, N-methylglucamine, chloroprocaine, choline, diethanolamine, ethylenediamine, procaine and the like.

A pharmaceutical composition of the invention also may also include a pharmaceutically acceptable antioxidant. Examples of pharmaceutically acceptable antioxidants include: (1) water soluble antioxidants, such as ascorbic acid, cysteine hydrochloride, sodium bisulfate, sodium metabisulfite, sodium sulfite and the like; (2) oil-soluble antioxidants, such as ascorbyl palmitate, butylated hydroxyanisole (BHA), butylated hydroxytoluene (BHT), lecithin, propyl gallate, alpha-tocopherol, and the like; and (3) metal chelating agents, such as citric acid, ethylenediamine tetraacetic acid (EDTA), sorbitol, tartaric acid, phosphoric acid, and the like.

Examples of suitable aqueous and nonaqueous carriers that may be employed in the pharmaceutical compositions of the invention include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

These compositions may also contain adjuvants such as preservatives, wetting agents, emulsifying agents and dispersing agents. Prevention of presence of microorganisms may be ensured both by sterilization procedures, and by the inclusion of various antibacterial and antifungal agents, for example, paraben, chlorobutanol, phenol sorbic acid, and the like. It may also be desirable to include isotonic agents, such as sugars, sodium chloride, and the like into the compositions. In addition, prolonged absorption of the injectable pharmaceutical form may be brought about by the inclusion of agents which delay absorption such as aluminum monostearate and gelatin.

Pharmaceutically acceptable carriers include sterile aqueous solutions or dispersions and sterile powders for the extemporaneous preparation of sterile injectable solutions or dispersion. The use of such media and agents for pharmaceutically active substances is known in the art. Except insofar as any conventional media or agent is incompatible with the active compound, use thereof in the pharmaceutical compositions of the invention is contemplated. Supplementary active compounds can also be incorporated into the compositions.

Therapeutic compositions typically must be sterile and stable under the conditions of manufacture and storage. The composition can be formulated as a solution, microemulsion, liposome, or other ordered structure suitable to high drug concentration. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, or sodium chloride in the composition. Prolonged absorption of the injectable compositions can be brought about by including in the composition an agent that delays absorption, for example, monostearate salts and gelatin.

Sterile injectable solutions can be prepared by incorporating the active compound in the required amount in an appropriate solvent with one or a combination of ingredients enumerated above, as required, followed by sterilization microfiltration. Generally, dispersions are prepared by incorporating the active compound into a sterile vehicle that contains a basic dispersion medium and the required other ingredients from those enumerated above. In the case of sterile powders for the preparation of sterile injectable solutions, the certain methods of preparation are vacuum drying and freeze-drying (lyophilization) that yield a powder of the active ingredient plus any additional desired ingredient from a previously sterile-filtered solution thereof.

The amount of active ingredient which can be combined with a carrier material to produce a single dosage form will vary depending upon the subject being treated, and the particular mode of administration. The amount of active ingredient which can be combined with a carrier material to produce a single dosage form will generally be that amount of the composition which produces a therapeutic effect. Generally, out of one hundred percent, this amount will range from about 0.01 percent to about ninety-nine percent of active ingredient, preferably from about 0.1 percent to about 70 percent, most preferably from about 1 percent to about 30 percent of active ingredient in combination with a pharmaceutically acceptable carrier.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms of the invention are dictated by and directly dependent on (a) the unique characteristics of the active compound and the particular therapeutic effect to be achieved, and (b) the limitations inherent in the art of compounding such an active compound for the treatment of sensitivity in individuals.

For administration of a mammalian polypeptide of interest, in particular where the mammalian polypeptide is an antibody, the dosage ranges from about 0.0001 to 100 mg/kg, and more usually 0.01 to 5 mg/kg, of the host body weight. For example, dosages can be 0.3 mg/kg body weight, 1 mg/kg body weight, 3 mg/kg body weight, 5 mg/kg body weight or 10 mg/kg body weight or within the range of 1-10 mg/kg. An exemplary treatment regime entails administration once per week, once every two weeks, once every three weeks, once every four weeks, once a month, once every 3 months or once every three to 6 months. Certain dosage regimens for an antibody may include 1 mg/kg body weight or 3 mg/kg body weight via intravenous administration, with the antibody being given using one of the following dosing schedules: (i) every four weeks for six dosages, then every three months; (ii) every three weeks; (iii) 3 mg/kg body weight once followed by 1 mg/kg body weight every three weeks.

Alternatively a mammalian polypeptide of interest can be administered as a sustained release formulation, in which case less frequent administration is required. Dosage and frequency vary depending on the half-life of the administered substance in the patient. In general, human antibodies show the longest half life, followed by humanized antibodies, chimeric antibodies, and nonhuman antibodies. The dosage and frequency of administration can vary depending on whether the treatment is prophylactic or therapeutic. In prophylactic applications, a relatively low dosage is administered at relatively infrequent intervals over a long period of time. Some patients continue to receive treatment for the rest of their lives. In therapeutic applications, a relatively high dosage at relatively short intervals is sometimes required until progression of the disease is reduced or terminated, and preferably until the patient shows partial or complete amelioration of symptoms of disease. Thereafter, the patient can be administered a prophylactic regime.

Actual dosage levels of the active ingredients in the pharmaceutical compositions of the present disclosure may be varied so as to obtain an amount of the active ingredient which is effective to achieve the desired therapeutic response for a particular patient, composition, and mode of administration, without being toxic to the patient. The selected dosage level will depend upon a variety of pharmacokinetic factors including the activity of the particular compositions of the present invention employed, or the ester, salt or amide thereof, the route of administration, the time of administration, the rate of excretion of the particular compound being employed, the duration of the treatment, other drugs, compounds and/or materials used in combination with the particular compositions employed, the age, sex, weight, condition, general health and prior medical history of the patient being treated, and like factors well known in the medical arts.

A "therapeutically effective dosage" of an immunoglobulin of the present disclosure preferably results in a decrease in severity of disease symptoms, an increase in frequency and duration of disease symptom-free periods, or a prevention of impairment or disability due to the disease affliction. For example, for the treatment of tumors, a "therapeutically effective dosage" preferably inhibits cell growth or tumor growth by at least about 20%, more preferably by at least about 40%, even more preferably by at least about 60%, and still more preferably by at least about 80% relative to untreated subjects. The ability of a compound to inhibit tumor growth can be evaluated in an animal model system predictive of efficacy in human tumors. Alternatively, this property of a composition can be evaluated by examining the ability of the compound to inhibit, such inhibition in vitro by assays known to the skilled practitioner. A therapeutically effective amount of a therapeutic compound can decrease tumor size, or otherwise ameliorate symptoms in a subject. One of ordinary skill in the art would be able to determine such amounts based on such factors as the subject's size, the severity of the subject's symptoms, and the particular composition or route of administration selected.

A composition of the present disclosure can be administered via one or more routes of administration using one or more of a variety of methods known in the art. As will be appreciated by the skilled artisan, the route and/or mode of administration will vary depending upon the desired results. Certain routes of administration for binding moieties of the invention include intravenous, intramuscular, intradermal, intraperitoneal, subcutaneous, spinal or other parenteral routes of administration, for example by injection or infusion. The phrase "parenteral administration" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Alternatively, a mammalian polypeptide according to the present disclosure can be administered via a nonparenteral route, such as a topical, epidermal or mucosal route of administration, for example, intranasally, orally, vaginally, rectally, sublingually or topically.

The active compounds can be prepared with carriers that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. (see, e.g., *Sustained and Controlled Release Drug Delivery Systems*, J. R. Robinson, ed., Marcel Dekker, Inc., New York, 1978).

Therapeutic compositions can be administered with medical devices known in the art. For example, in a certain embodiment, a therapeutic composition of the invention can be administered with a needleless hypodermic injection device, such as the devices disclosed in U.S. Pat. Nos. 5,399,163; 5,383,851; 5,312,335; 5,064,413; 4,941,880; 4,790,824; or 4,596,556. Examples of well-known implants and modules useful in the present invention include: U.S. Pat. No. 4,487,603, which discloses an implantable microinfusion pump for dispensing medication at a controlled rate; U.S. Pat. No. 4,486,194, which discloses a therapeutic device for administering medicants through the skin; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments; and U.S. Pat. No. 4,475,196, which discloses an osmotic drug delivery system.

In certain embodiments, the use of mammalian polypeptides according to the present disclosure is for the treatment of any disease that may be treated with therapeutic antibodies.

Filamentous Fungal Cells of the Invention

The invention herein also relates to increasing the levels of production of heterologous polypeptides, such as mammalian polypeptides, in filamentous fungal cells by reducing or eliminating the activity of at least three proteases found in cells that express heterologous polypeptides, and that catalyze the degradation of the heterologous polypeptides. Reducing or eliminating the activity of proteases found in the filamentous fungal cells that express heterologous polypeptides increases the stability of the expressed recombinant polypeptides, which results in an increased level of production of the heterologous polypeptides. The activity of the proteases found in the filamentous fungal cells may be reduced, for example, by modifying the genes encoding the proteases.

"Filamentous fungal cells" include cells from all filamentous forms of the subdivision Eumycota and Oomycota (as defined by Hawksworth et al., In, Ainsworth and Bisby's Dictionary of The Fungi, 8th edition, 1995, CAB International, University Press, Cambridge, UK). Filamentous fungal cells are generally characterized by a mycelial wall composed of chitin, cellulose, glucan, chitosan, mannan, and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

Any filamentous fungal cell may be used in the present disclosure so long as it remains viable after being transformed with a sequence of nucleic acids and/or being modified or mutated to decrease protease activity. Preferably, the filamentous fungal cell is not adversely affected by the transduction of the necessary nucleic acid sequences, the subsequent expression of the proteins {e.g., mammalian proteins), or the resulting intermediates.

Examples of suitable filamentous fungal cells include, without limitation, cells from an *Acremonium, Aspergillus, Fusarium, Humicola, Mucor, Myceliophthora, Neurospora, Penicillium, Scytalidium, Thielavia, Tolypocladium*, or *Trichoderma* strain. In certain embodiments, the filamentous fungal cell is from a *Trichoderma* sp., *Acremonium, Aspergillus, Aureobasidium, Cryptococcus, Chrysosporium, Chrysosporium lucknowense, Filibasidium, Fusarium, Gibberella, Magnaporthe, Mucor, Myceliophthora, Myrothecium, Neocallimastix, Neurospora, Paecilomyces, Penicillium, Piromyces, Schizophyllum, Talaromyces, Thermoascus, Thielavia*, or *Tolypocladium* strain.

*Aspergillus* fungal cells of the present disclosure may include, without limitation, *Aspergillus aculeatus, Aspergillus awamori, Aspergillus clavatus, Aspergillus flavus, Aspergillus foetidus, Aspergillus fumigatus, Aspergillus japonicus, Aspergillus nidulans, Aspergillus niger, Aspergillus oryzae*, or *Aspergillus terreus*.

*Neurospora* fungal cells of the present disclosure may include, without limitation, *Neurospora crassa*.

In certain embodiments, the filamentous fungal cell is not an *Aspergillus* cell.

In certain embodiments, the filamentous fungal cell is selected from the group consisting of *Trichoderma* (*T. reesei*), *Neurospora* (*N. crassa*), *Penicillium* (*P. chrysogenum*), *Aspergillus* (*A. nidulans, A. niger* and *A. oryzae*), *Myceliophthora* (*M. thermophila*) and *Chrysosporium* (*C. lucknowense*).

In certain embodiments, the filamentous fungal cell is a *Trichoderma* fungal cell. *Trichoderma* fungal cells of the present disclosure may be derived from a wild-type *Trichoderma* strain or a mutant thereof. Examples of suitable *Trichoderma* fungal cells include, without limitation, *Trichoderma harzianum, Trichoderma koningii, Trichoderma longibrachiatum, Trichoderma reesei, Trichoderma atroviride, Trichoderma virens, Trichoderma viride*; and alternative sexual form thereof (i.e., *Hypocrea*).

General methods to disrupt genes of and cultivate filamentous fungal cells are disclosed, for example, for *Penicillium*, in Kopke et al. (2010) Application of the *Saccharomyces cerevisiae* FLP/FRT recombination system in filamentous fungi for marker recycling and construction of knockout strains devoid of heterologous genes. Appl Environ Microbiol. 76(14):4664-74. doi: 10.1128/AEM.00670-10, for *Aspergillus*, in Maruyama and Kitamoto (2011), Targeted Gene Disruption in Koji Mold *Aspergillus oryzae*, in James A. Williams (ed.), Strain Engineering: Methods and Protocols, Methods in Molecular Biology, vol. 765, DOI 10.1007/978-1-61779-197-0_27; for *Neurospora*, in Collopy et al. (2010) High-throughput construction of gene deletion cassettes for generation of *Neurospora crassa* knockout strains. Methods Mol Biol. 2010; 638:33-40. doi: 10.1007/978-1-60761-611-5_3; and for *Myceliophthora* or *Chrysosporium* PCT/NL2010/000045 and PCT/EP98/06496.

Filamentous Fungal Cell Components

Certain aspects of the present disclosure relate to filamentous fungal cells having reduced or no detectable activity of at least three proteases and having a recombinant polynucleotide encoding a heterologous polypeptide that is produced at increased levels, for example at least two-fold increased levels. Other aspects of the present disclosure relate to *Trichoderma* fungal cells that has reduced or no detectable protease activity of at least three proteases selected from pep1, pep2, pep3, pep4, pep5, pep8, pep11, pep12, tsp1, slp1, slp2, slp7, gap1, and gap2, where the cell further contains a recombinant polynucleotide encoding a mammalian polypeptide produced at a level of at least 2-fold higher than the production level of the polypeptide in a corresponding parental *Trichoderma* fungal cell. In certain embodiments, the filamentous fungal cells or *Trichoderma* fungal cells have reduced or no activity of at least four, at least five, at least six, at least seven, at least eight, at least nine, at least ten, at least eleven, at least twelve, or more proteases.

Reduced Expression of Proteases

The reduced activity of the at least three proteases in filamentous fungal cells or *Trichoderma* fungal cells of the present disclosure can be the result of reduced or eliminated expression of the proteases. In some embodiments, the reduced or eliminated expression of the at least three proteases is the result of a modification to the catalytic domain, the coding region, or a control sequence required for expression of the coding region of the genes encoding each of the proteases. In other embodiments, the reduced or eliminated expression of the proteases is the result of introducing, substituting, and/or removing one or more nucleotides in the genes, or a control sequence thereof required for the transcription or translation of the genes encoding each of the proteases.

In further embodiments, the reduced or eliminated expression of the proteases is the result of inserting into the genes encoding each of the proteases disruptive nucleic acid constructs each containing a nucleic acid fragment homologous to each of the genes that will create a duplication of the region of homology and incorporate construct DNA between the duplicated regions. In other embodiments, the reduced or eliminated expression of the proteases is the result of gene conversion of the genes encoding each of the proteases. In still other embodiments, the reduced or eliminated expression of the proteases is the result of by anti-sense polynucleotides or RNAi constructs that are specific for the each of the genes encoding each of the proteases. In one embodiment, an RNAi construct is specific for a gene encoding an aspartic protease such as a pep-type protease, a trypsin-like serine proteases such as a tsp1, a glutamic protease such as a gap-type, protease, a subtilisin protease such as a slp-type protease, or a sedolisin protease such as a tpp1 or a slp7 protease. In one embodiment, an RNAi construct is specific for the gene encoding a slp-type protease. In one embodiment, an RNAi construct is specific for the gene encoding slp2, slp3, slp5 or slp6. In one embodiment, an RNAi construct is specific for two or more proteases. In one embodiment, two or more proteases are any one of the pep-type proteases, any one of the trypsin-like serine proteasess, any one of the slp-type proteases, any one of the gap-type proteases and/or any one of the sedolisin proteases. In one embodiment, two or more proteases are slp2, slp3, slp5 and/or slp6. In one embodiment, RNAi construct comprises any one of nucleic acid sequences of Table 22.2.

In some embodiments, the genes encoding the proteases each contain a mutation that reduces or eliminates the corresponding protease activity. In other embodiments, the mutation reduces or eliminates the expression of each of the proteases. In further embodiments, the mutation is a knockout mutation, a truncation mutation, a point mutation, a mis sense mutation, a substitution mutation, a frameshift mutation, an insertion mutation, a duplication mutation, an amplification mutation, a translocation mutation, an inversion mutation that reduces or eliminates the corresponding protease activity.

In some embodiments, the mutation is a deletion of the protease encoding gene. In other embodiments, the mutation is a deletion of the portion of the protease encoding gene encoding the catalytic domain of the protease. In still other embodiments, the mutation is point mutation in the portion of the protease encoding gene encoding the catalytic domain of the protease.

Combinations of Protease Genes

The filamentous fungal cells or *Trichoderma* fungal cells of the present disclosure may contain at least three, at least four, at least five, at least six, at least seven, at least eight, at least nine, at least ten, or more aspartic proteases, trypsin-like serine proteases, subtilisin proteases, and/or glutamic proteases. In certain embodiments, the proteases are encoded by pep-type protease genes, gap-type protease genes, or slp-type proteases genes. In some embodiments, the pep-type protease genes are selected from pep1, pep2, pep3, pep4, pep5, pep8, pep11, and pep12. In other embodiments, the gap-type protease genes are selected from gap1, and gap2. In further embodiments, the slp-type proteases genes are selected from slp1, slp2, slp3, and slp7; or are selected from slp1, slp2, slp3, slp5, slp6, slp7, and slp8. In certain preferred embodiments, the slp-type proteases gene is slp1.

In other embodiments, the proteases are encoded by genes selected from pep1, pep2, pep3, pep4, pep5, pep7, pep8, pep11, pep1 2, tsp1, slp1, slp2, slp3, slp5, slp6, slp7, slp8, gap1, gap2, and tpp1. In some embodiments, the filamentous fungal cell, for example, a *Trichoderma* cell has reduced or no expression levels of at least three or at least four protease encoding genes selected from pep1, pep2, pep3, pep4, pep5, pep8, pep11, pep12, tsp1, slp1, slp2, slp3, slp7, gap1, and gap2. In certain embodiments, the filamentous fungal cell, for example a *Trichoderma* cell, has reduced or no expression levels of at least three protease encoding genes selected from pep1, tsp1, and slp1. In other embodiments, the filamentous fungal cell, or *Trichoderma* cell, has reduced or no expression levels of at least three protease encoding genes selected from gap1, slp1 and pep1. In some embodiments, the filamentous fungal cell, for example, a *Trichoderma* cell has reduced or no expression levels of protease encoding genes slp2, pep1, and gap1. In some embodiments, the filamentous fungal cell, for example, a *Trichoderma* cell has reduced or no expression levels of protease encoding genes slp2, pep1, gap1, and pep4. In some embodiments, the filamentous fungal cell, for example, a *Trichoderma* cell has reduced or no expression levels of protease encoding genes slp2, pep1, gap1, pep4, and slp1. In some embodiments, the filamentous fungal cell, for example, a *Trichoderma* cell has reduced or no expression levels of protease encoding genes slp2, pep1, gap1, pep4, slp1, and slp3. In some embodiments, the filamentous fungal cell, for example, a *Trichoderma* cell has reduced or no expression levels of protease encoding genes slp2, pep1, gap1, pep4, slp1, slp3, and pep3. In some embodiments, the filamentous fungal cell, for example, a *Trichoderma* cell has reduced or no expression levels of protease encoding genes slp2, pep1, gap1, pep4, slp1, slp3, pep3, and pep2. In some embodiments, the filamentous fungal cell, for example, a *Trichoderma* cell has reduced or no expression levels of protease encoding genes slp2, pep1, gap1, pep4, slp1, slp3, pep3, pep2, and pep5. In some embodiments, the filamentous fungal cell, for example, a *Trichoderma* cell has reduced or no expression levels of protease encoding genes slp2, pep1, gap1, pep4, slp1, slp3, pep3, pep2, pep5, and tsp1. In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, and slp7. In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, slp7, and slp8. In some embodiments, the filamentous fungal cell, for example, a *Trichoderma* cell has reduced or no expression levels of protease encoding genes slp2, pep1, gap1, pep4, slp1, slp3, pep3, pep2, pep5, tsp1, slp7, slp8, and gap2.

In certain embodiments, the filamentous fungal cell has at least three, at least four, at least five, at least six, at least seven, at least eight, at least nine, at least ten, or more proteases with reduced protease activity, wherein the corresponding proteases with wild type activity each have an amino acid sequence that is at least 70%, at least 75%, at least 80%, at least 85%, at least 90%, at least 95%, at least 96%, at least 97%, at least 98%, at least 99%, or 100% identical to the amino acid sequences of SEQ ID NOs: 1-16; 17-36; 37-57; 58-65; 66-81; 82-97; 98-117; 118-128; 129-144; 166-181; 182-185; or SEQ ID NOs:491-588. In embodiments where the filamentous fungal cell is a *Trichoderma* fungal cell with reduced protease activity in one or more proteases, wherein the corresponding proteases with wild type activity each have an amino acid sequence that is at least 70%, at least 75%, at least 80%, at least 85%, at least 90%, at least 95%, at least 96%, at least 97%, at least 98%, at least 99%, or 100% identical to the amino acid sequences of SEQ ID NOs: 1, 17, 37, 58, 66, 82, 98, 118, 129, 166, or 182; or SEQ ID NO:507, SEQ ID NO:522, or SEQ ID NO:530.

Heterologous Polypeptides

The filamentous fungal cells or *Trichoderma* fungal cells of the present disclosure contain a recombinant polynucleotide encoding a heterologous polypeptide. In certain embodiments, the heterologous polypeptide is a mammalian polypeptide. In other embodiments, heterologous polypeptide is a non-mammalian polypeptide.

In embodiments where the filamentous fungal cell contains a recombinant polynucleotide encoding a mammalian polypeptide, the mammalian polypeptide can be a non-glycosylated mammalian polypeptide, a glycosylated mammalian polypeptide, or combinations thereof, including, without limitation, an immunoglobulin, an antibody, a growth factor, and an interferon. In some embodiments, the mammalian polypeptide is an immunoglobulin or antibody. In embodiments where the filamentous fungal cell contains a recombinant polynucleotide encoding an immunoglobulin or antibody, the filamentous fungal cell, for example, a *Trichoderma* fungal cell may have reduced or no expression of at least three or at least four protease encoding genes selected from pep1, pep3, pep4, pep8, pep11, pep12, tsp1, slp1, slp2, slp7, gap1, and gap2. In certain preferred embodiments, the cell, for example a *Trichoderma* fungal cell, contains a recombinant polynucleotide encoding an immunoglobulin or antibody and has reduced or no expression of the protease encoding genes slp1, slp2, slp3, tsp1, pep1, gap1, pep4, pep3, pep2, pep5, and gap2. In certain preferred embodiments, the cell, for example a *Trichoderma* fungal cell, contains a recombinant polynucleotide encoding an immunoglobulin or antibody and has reduced or no expression of the protease encoding genes pep1, tsp1, slp1, and gap1. In other embodiments, the cell contains a recombinant polynucleotide encoding an immunoglobulin or antibody and has reduced expression of the protease encoding genes pep1, tsp1, slp1, gap1, and pep4. In other embodiments, the cell contains a recombinant polynucleotide encoding an immunoglobulin or antibody and has reduced expression of the protease encoding genes slp1, slp2, and slp3. In other embodiments, the cell contains a recombinant polynucleotide encoding an immunoglobulin or antibody and has reduced expression of the protease encoding genes slp1, slp2, slp3, and tsp1. In other embodiments, the cell contains a recombinant polynucleotide encoding an immunoglobulin or antibody and has reduced expression of the protease encoding genes slp1, slp2, slp3, tsp1, and pep1. In other embodiments, the cell contains a recombinant polynucleotide encoding an immunoglobulin or antibody and has reduced expression of the protease encoding genes slp1, slp2, slp3, tsp1, pep1, and gap1. In other embodiments, the cell contains a recombinant polynucleotide encoding an immunoglobulin or antibody and has reduced expression of the protease encoding genes slp1, slp2, slp3, tsp1, pep1, gap1, and pep4. In other embodiments, the cell contains a recombinant polynucleotide encoding an immunoglobulin or antibody and has reduced expression of the protease encoding genes slp1, slp2, slp3, tsp1, pep1, gap1, pep4, and pep3. In other embodiments, the cell contains a recombinant polynucleotide encoding an immunoglobulin or antibody and has reduced expression of the protease encoding genes slp1, slp2, slp3, tsp1, pep1, gap1, pep4, pep3, and pep2. In other embodiments, the cell contains a recombinant polynucleotide encoding an immunoglobulin or antibody and has reduced expression of the protease encoding genes slp1, slp2, slp3, tsp1, pep1, gap1, pep4, pep3, pep2, and pep5.

In other embodiments, the filamentous fungal cell contains a recombinant polynucleotide encoding a growth factor, interferon, cytokine, or interleukin. In embodiments where the filamentous fungal cell, for example a *Trichoderma* fungal cell contains a recombinant polynucleotide encoding a growth factor, interferon, cytokine, human serum albumin, or interleukin, the filamentous fungal cell may have reduced or no expression of at least three or at least four protease encoding genes selected from pep1, pep2, pep3, pep4, pep5, pep8, gap1, gap2, slp1, slp2, slp7, and tsp1. In certain embodiments, the cell contains a recombinant polynucleotide encoding a growth factor, interferon, cytokine, human serum albumin, or interleukin and has reduced expression of the protease encoding genes pep1, tsp1, slp1, gap1, and gap2. In certain embodiments, the cell contains a recombinant polynucleotide encoding a growth factor, interferon, cytokine, human serum albumin, or interleukin and has reduced expression of the protease encoding genes slp1, slp2, pep1, gap1, pep4, slp7, pep2, pep3, pep5, tsp1, and gap2. In other embodiments, the cell, for example a *Trichoderma* fungal cell, contains a recombinant polynucleotide encoding a growth factor, interferon, cytokine, human serum albumin, or interleukin and has reduced expression of the protease encoding genes pep1, tsp1, slp1, gap1, gap2, and pep4. In a further embodiment, the cell contains a recombinant polynucleotide encoding a growth factor, and has reduced expression of a pep-type protease genes are selected from pep1, pep2, pep3, pep4, and pep5. In certain preferred embodiments, the growth factor is IGF-1 or the interferon is interferon-α 2b. In certain embodiments, the cell contains a recombinant polynucleotide encoding a growth factor, interferon, cytokine, human serum albumin, or interleukin and has reduced expression of the protease encoding genes pep1, gap1, and pep4. In certain embodiments, the cell contains a recombinant polynucleotide encoding a growth factor, interferon, cytokine, human serum albumin, or interleukin and has reduced expression of the protease encoding genes pep1, gap1, pep4, and slp7. In certain embodiments, the cell contains a recombinant polynucleotide encoding a growth factor, interferon, cytokine, human serum albumin, or interleukin and has reduced expression of the protease encoding genes pep1, gap1, pep4, slp7, and slp2. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, and pep2. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, and pep3. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, and pep5. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, pep5, and slp1. In certain embodiments, the cell contains a recombinant polynucleotide encoding a growth factor, interferon, cytokine, human serum albumin, or interleukin and has reduced expression of the protease encoding genes pep1, gap1, pep4, slp7, slp2, pep2, pep3, pep5, slp1, and tsp1.

In certain embodiments, the mammalian polypeptide is produced at a level that is at least 3-fold, at least 4-fold, at least 5-fold, at least 6-fold, at least 7-fold, at least 8-fold, at least Si-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher than the production level of the polypeptide in a corresponding parental filamentous fungal cell without the reduced protease activity. In other embodiments, the mammalian polypeptide is produced in a full length version at a level higher than the production level of the full-length version of the polypeptide in a corresponding parental filamentous fungal cell.

In embodiments where the filamentous fungal cell contains a recombinant polynucleotide encoding a non-mammalian polypeptide, the non-mammalian polypeptide may be an aminopeptidase, amylase, carbohydrase, carboxypeptidase, catalase, cellulase, chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase or xylanase. In embodiments where the filamentous fungal cell contains a recombinant polynucleotide encoding a non-mammalian polypeptide, the filamentous fungal cell may have reduced or no detectable expression of at least three, at least four, at least five, or at least six protease encoding genes selected from pep1, pep2, pep3, pep4, pep5, pep8, pep11, pep12, tsp1, slp1, slp2, slp3, gap1, and gap2. In certain embodiments, the non-mammalian polypeptide is produced at a level that is at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher than the production level of the polypeptide in a corresponding parental filamentous fungal cell. In other embodiments, the non-mammalian polypeptide is produced in a full length version at a level higher than the production level of the full-length version of the polypeptide in a corresponding parental filamentous fungal cell.

Reduced Activity of Additional Proteases

In some embodiments, the filamentous fungal cells or Trichoderma fungal cells of the present disclosure also have reduced activity of one or more additional proteases. In certain embodiments, the expression level of the one or more additional proteases is reduced. In certain preferred embodiments, genes encoding the one or more additional proteases each comprise a mutation that reduces the corresponding protease activity. The one or more additional protease encoding genes may be pep7, tpp1, gap2, slp3, slp5, slp6, slp7, or slp8.

In certain embodiments, when the filamentous fungal cells is an *Aspergillus* cell, the total protease activity is reduced to 50% or less of the total protease activity in the corresponding parental *Aspergillus* cell in which the proteases do not have reduced activity.

In certain embodiments, total protease activity is reduced in the cell of the present disclosure, for example a *Trichoderma* cell, to 49% or less, 31% or less, 13% or less, 10% or less, 6.3% or less, or 5.5% or less, of the total protease activity in the corresponding parental filamentous fungal cell in which the proteases do not have reduced activity.

Additional Recombinant Modifications

In certain embodiments, the filamentous fungal cells or Trichoderma fungal cells of the present disclosure also have reduced activity of a dolichyl-P-Man:Man(5)GlcNAc(2)-PP-dolichyl mannosyl transferase. Dolichyl-P-Man: Man(5) GlcNAc(2)-PP-dolichyl mannosyltransferase (EC 2.4.1.130) transfers an alpha-D-mannosyl residue from dolichyl-phosphate D-mannose into a membrane lipid-linked oligosaccharide. Typically, the dolichyl-P-Man:Man (5)GlcNAc(2)-PP-dolichyl mannosyltransferase enzyme is encoded by an alg3 gene. Thus, in certain embodiments, the filamentous fungal cell has reduced activity of ALG3, which is the activity encoded by the alg3 gene. In some embodiments, the alg3 gene contains a mutation that reduces the corresponding ALG3 activity. In certain embodiments, the alg3 gene is deleted from the filamentous fungal cell.

In other embodiments, the filamentous fungal cells or Trichoderma fungal cells of the present disclosure further contain a polynucleotide encoding an α-1,2-mannosidase. The polynucleotide encoding the α-1,2-mannosidase may be endogenous in the host cell, or it may be heterologous to the host cell. These polynucleotides are especially useful for a filamentous fungal cell expressing high-mannose glycans transferred from the Golgi to the ER without effective exo-α-2-mannosidase cleavage. The α-1,2-mannosidase may be a mannosidase I type enzyme belonging to the glycoside hydrolase family 47 (cazy.org/GH47_all.html). In certain embodiments the α-1,2-mannosidase is an enzyme listed at cazy.org/GH47_characterized.html. In particular, the α-1,2-mannosidase may be an ER-type enzyme that cleaves glycoproteins such as enzymes in the subfamily of ER α-mannosidase I EC 3.2.1.113 enzymes. Examples of such enzymes include human α-2-mannosidase IB (AAC26169), a combination of mammalian ER mannosidases, or a filamentous fungal enzyme such as α-1,2-mannosidase (MDS1) (*T. reesei* AAF34579; Maras M et al J Biotech. 77, 2000, 255). For ER/Golgi expression the catalytic domain of the mannosidase is typically fused with a targeting peptide, such as HDEL, KDEL, or part of an ER or early Golgi protein, or expressed with an endogenous ER targeting structures of an animal or plant mannosidase I enzyme, see, for example, Callewaert et al. 2001 Use of HDEL-tagged *Trichoderma reesei* mannosyl oligosaccharide 1,2-α-D-mannosidase for N-glycan engineering in *Pichia pastoris*. FEBS Lett 503: 173-178.

In further embodiments, the filamentous fungal cells or Trichoderma fungal cells of the present disclosure also contain an N-acetylglucosaminyltransferase I catalytic domain and anN-acetylglucosaminyltransferase II catalytic domain. Such catalytic domains are useful for expressing complex N-glycans in non-mammalian cells. N-acetylglucosaminyltransferase I(GlcNAc-TI; GnTI; EC 2.4.1.101) catalyzes the reaction UDP-N-acetyl-D-glucosamine+3-(alpha-D-mannosyl)-beta-D-mannosyl-R<=>UDP+3-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase I catalytic domain is any portion of an N-acetylglucosaminyltransferase I enzyme that is capable of catalyzing this reaction. N-acetylglucosaminyltransferase II (GlcNAc-TII; GnTII; EC 2.4.1.143) catalyzes the reaction UDP-N-acetyl-D-glucosamine+6-(alpha-D-mannosyl)-beta-D-mannosyl-R<=>UDP+6-(2-(N-acetyl-beta-D-glucosaminyl)-alpha-D-mannosyl)-beta-D-mannosyl-R, where R represents the remainder of the N-linked oligosaccharide in the glycan acceptor. An N-acetylglucosaminyltransferase II catalytic domain is any portion of an N-acetylglucosaminyltransferase II enzyme that is capable of catalyzing this reaction. Examples of suitable N-acetylglucosaminyltransferase I catalytic domains and an N-acetylglucosaminyltransferase II catalytic domains can be found in International Patent Application No. PCT/EP2011/070956. The N-acetylglucosaminyltransferase I catalytic domain and N-acetylglucosaminyltransferase II catalytic domain can be encoded by a single polynucleotide. In certain embodiments, the single polynucleotide encodes a fusion protein containing the N-acetylglucosaminyltransferase I catalytic domain and the N-acetylglucosaminyltransferase II catalytic domain. Alternatively, the N-acetylglucosaminyltransferase I catalytic domain can be encoded by a first polynucleotide and the N-acetylglucosaminyltransferase II catalytic domain can be encoded by a second polynucleotide.

In embodiments where, the filamentous fungal cell or Trichoderma fungal cell contains an N-acetylglucosaminyltransferase I catalytic domain and an N-acetylglucosaminyltransferase II catalytic domain, the cell can also contain a polynucleotide encoding a mannosidase II. Mannosidase II enzymes are capable of cleaving Man5 structures of GlcNAcMan5 to generate GlcNAcMan3, and if combined with action of a catalytic domain of GnTII, to generate G0; and further, with action of a catalytic domain of a galactosyl transferase, to generate G1 and G2. In certain embodiments mannosidase II-type enzymes belong to glycoside hydrolase family 38 (cazy.org/GH38_all.html). Examples of such enzymes include human enzyme AAC50302, *D. melanogaster* enzyme (Van den Elsen J. M. et al (2001) EMBO J. 20: 3008-3017), those with the 3D structure according to PDB-reference 1HTY, and others referenced with the catalytic domain in PDB. For ER/Golgi expression, the catalytic domain of the mannosidase is typically fused with an N-terminal targeting peptide, for example using targeting peptides listed in the International Patent Application No. PCT/EP2011/070956 or of SEQ ID NOs 589-594. After transformation with the catalytic domain of a mannosidase II-type mannosidase, a strain effectively producing GlcNAc2Man3, GlcNAclMan3 or G0 is selected.

In certain embodiments that may be combined with the preceding embodiments, the filamentous fungal cell further contains a polynucleotide encoding a UDP-GlcNAc transporter.

In certain embodiments that may be combined with the preceding embodiments, the filamentous fungal cell further contains a polynucleotide encoding a β-1,4-galactosyltransferase. Generally, β-1,4-galactosyl transferases belong to the CAZy glycosyl transferase family 7 (cazy.org/ GT7_all.html). Examples of useful 4GalT enzymes include 4GalT1, e.g. bovine *Bos taurus* enzyme AAA30534.1 (Shaper N. L. et al Proc. Natl. Acad. Sci. U.S.A. 83 (6), 1573-1577 (1986)), human enzyme (Guo S. et al. Glycobiology 2001, 11:813-20), and *Mus musculus* enzyme AAA37297 (Shaper, N. L. et al. 1998 J. Biol. Chem. 263 (21), 10420-10428). In certain embodiments of the invention where the filamentous fungal cell contains a polynucleotide encoding a galactosyltransferase, the filamentous fungal cell also contains a polynucleotide encoding a UDP-Gal 4 epimerase and/or UDP-Gal transporter. In certain embodiments of the invention where the filamentous fungal cell contains a polynucleotide encoding a galactosyltransferase, lactose may be used as the carbon source instead of glucose when culturing the host cell. The culture medium may be between pH 4.5 and 7.0 or between 5.0 and 6.5. In certain embodiments of the invention where the filamentous fungal cell contains a polynucleotide encoding a galactosyltransferase and, optionally, a polynucleotide encoding a UDP-Gal 4 epimerase and/or UDP-Gal transporter, a divalent cation such as Mn2+, Ca2+ or Mg2+ may be added to the cell culture medium.

In certain embodiments that may be combined with the preceding embodiments, the level of activity of alpha-1,6-mannosyltransferase in the host cell is reduced compared to the level of activity in a wild-type host cell. In certain embodiments, the filamentous fungal has a reduced level of expression of an och1 gene compared to the level of expression in a wild-type filamentous fungal cell.

Another aspect includes methods of producing a Man3GlcNAc2 N-glycan [i.e. Mana3(Manoc6)Man 4GlcNAc 4GlcNAc] in a filamentous fungal cell including the steps of providing a filamentous fungal cell with a recombinant polynucleotide encoding a heterologous polypeptide and a reduced level of activity of an alg3 mannosyltransferase compared to the level of activity in a wild-type filamentous fungal cell and culturing the filamentous fungal cell to produce a Man3GlcNAc2 glycan, where the Man3GlcNAc2 glycan constitute at least 10%, at least 20%, at least 30%, at least 40%, at least 50%, at least 60%, at least 70%, at least 80%, at least 90%, or 100% (mol %) of the neutral N-gl yeans secreted by the filamentous fungal cell. In certain embodiment, Man3GlcNAc2 N-glycan represents at least 10%, at least 20%, at least 30%, at least 40%, at least 50%, at least 60%, at least 70%, at least 80%, at least 90%, or 100% (mol %) of the total N-glycans of the heterologous polypeptide.

Another aspect includes methods of producing a complex N-glycan (i.e an N-glycan comprising a terminal GlcNAc2Man3 structure), for example GlcNAc2Man3GlcNAc2 {i.e. G0, i.e. GlcNAc 2Man 3(GlcNAc 2Man 6)Man 4GlcNAc 4GlcNAc} glycan in a filamentous fungal cell including the steps of providing a filamentous fungal cell with a recombinant polynucleotide encoding a heterologous polypeptide, a reduced level of activity of an alg3 mannosyltransferase compared to the level of activity in a wild-type filamentous fungal cell and comprising further a polynucleotide encoding an N-acetylglucosaminyltransferase I catalytic domain and a polynucleotide encoding an N-acetylglucosaminyltransferase II catalytic domain and culturing the filamentous fungal cell to produce the complex N-glycan, for example GlcNAc2Man3GlcNAc2 glycan, where the GlcNAc2Man3GlcNAc2 glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiments, the complex N-glycan, for example GlcNAc2Man3GlcNAc2 glycan, represents at least 5%, at least 10%, at least 20%, at least 30%, at least 40%, at least 50%, at least 60%, at least 70%, at least 80%, at least 90%, or 100% (mol %) of the total N-glycans of the polypeptide. In certain embodiments, said complex N-glycans are GlcNAcMan3 and/or GlcNAc2Man3.

Another aspect includes methods of producing a G1 or G2 N-glycan or mixture thereof, for example GalGlcNAc2Man3GlcNAc2 {i.e. G1, i.e. Gai 4GlcNAc 2Mana3(GlcNAc 2Mana6)Man 4GlcNAc 4GlcNAc} or GlcNAc 2Mana3(Gai 4GlcNAc 2Mana6)Man 4GlcNAc 4GlcNAc} and/or Gal2GlcNAc2Man3GlcNAc2 {i.e. G2, i.e. Gai 4GlcNAc 2Mana3(Gai 4 GlcNAc 2Mana6)Man 4GlcNAc 4GlcNAc} glycan in a filamentous fungal cell including the steps of providing a filamentous fungal cell with a recombinant polynucleotide encoding a heterologous polypeptide and a reduced level of activity of an alg3 mannosyltransferase compared to the level of activity in a wild-type filamentous fungal cell and comprising further a polynucleotide encoding an N-acetylglucosaminyltransferase I catalytic domain, a polynucleotide encoding an N-acetylglucosaminyltransferase II catalytic domain, and a polynucleotide encoding a GalT catalytic domain and culturing the filamentous fungal cell to produce the G1 or G2 N-glycan or mixture thereof, where G1 glycan constitutes at least 5%, at least 10%, at least 20%, at least 30%, at least 40%, at least 50%, at least 60%, at least 70%, at least 80%, at least 90%, or 100% (mol %) of the neutral N-gl yeans secreted by the filamentous fungal cell, or where the G2 glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiment, G1 glycan constitutes at least 10%, at least 20%, at least 30%, at least 40%, at least 50%, at least 60%, at least 70%, at least 80%, at least 90%, or 100% (mol %) of the total N-glycans of the polypeptide. In certain embodiment, G2 glycan constitutes at least 10%, at least 20%, at least 30%, at least 40%, at least 50%, at least 60%, at least 70%, at least 80%, at least 90%, or 100% (mol %) of the total N-glycans of the polypeptide.

In certain embodiments, the method of producing a complex N-glycan will generate a mixture of different glycans. The complex N-glycan or Man3GlcNAc2 may constitute at least 5%, at least 10%, at least 20%, at least 30%, at least 40%, at least 50%, at least 60%, at least 70%, at least 80%), or at least 90% or more of such a glycan mixture. In certain embodiments, at least 5%, at least 10%, at least 20%, at least 30%, at least 40%, at least 50%, at least 60%, at least 70%, at least 80%), or at least 90% or more of the N-glycans of the polypeptide consists of such a glycan mixture. In certain embodiments, the method of producing a complex and G1 and/or G2 N-glycan will generate a mixture of different glycans. The complex N-glycan, Man3GlcNAc2, G1 and/or G2 may constitute at least 5%, at least 10%, at least 20%, at least 30%, at least 40%, at least 50%, at least 60%, at least 70%, at least 80%), or at least 90% or more of such a glycan mixture. In certain embodiments, at least 5%, at least 10%, at least 20%, at least 30%, at least 40%, at least 50%, at least 60%, at least 70%, at least 80%), or at least 90% or more of the N-glycans of the polypeptide consists of such a glycan mixture.

In certain embodiments, methods of producing a hybrid N-glycan are desirable. As used herein, the term "hybrid" means a glycan containing both unsubstituted terminal mannose residues (as are present in high-mannose glycans) and substituted mannose residues with an N-acetylglucosamine linkage, for example GlcNAcβ2Manα3[Manα3(Manα6) Manα6]Man 4GlcNAc 4GlcNAc. In such embodiments, a Man5 {i.e Manα3[Manα3(Manα6)Manα6]Man 4GlcNAc 4GlcNAc} expressing filamentous fungal cell such as *T. reesei* strain is transformed with a recombinant polynucleotide encoding a heterologous polypeptide and a polynucleotide encoding an N-acetylglucosaminyltransferase I catalytic domain and the filamentous fungal cell is cultured to produce the hybrid N-glycan where the hybrid N-glycan constitutes at least 5%, at least 10%, at least 20%, at least 30%, at least 40%, at least 50%, at least 60%, at least 70%, at least 80%, at least 90%, or 100% (mol %) of the neutral N-glycans secreted by the filamentous fungal cell. In certain embodiment, at least 10%, at least 20%, at least 30%, at least 40%, at least 50%, at least 60%, at least 70%, at least 80%, at least 90%, or 100% (mol %) of the N-glycans of the polypeptide consists of a hybrid N-glycan.

The Man3GlcNAc2, complex, hybrid, G1, and G2 N-glycan may be attached to a molecule selected from an amino acid, a peptide, and a polypeptide. In certain embodiments, the Man3GlcNAc2, complex, hybrid, G1, and G2 N-glycan is attached to a heterologous polypeptide. In certain embodiments, the heterologous polypeptide is a glycosylated protein. In certain embodiment, the glycosylated polypeptide is a mammalian polypeptide. In certain embodiments, mammalian polypeptide is an antibody or its antigen-binding fragment.

In certain embodiments, glycosyltransferases, or example, GnTI, GnTII, or GalT or glycosylhydrolases, for example, α-1,2-mannosidase or mannosidase II, include a targeting peptide linked to the catalytic domains. The term "linked" as used herein means that two polymers of amino acid residues in the case of a polypeptide or two polymers of nucleotides in the case of a polynucleotide are either coupled directly adjacent to each other or are within the same polypeptide or polynucleotide but are separated by intervening amino acid residues or nucleotides. A "targeting peptide", as used herein, refers to any number of consecutive amino acid residues of the recombinant protein that are capable of localizing the recombinant protein to the endoplasmic reticulum (ER) or Golgi apparatus (Golgi) within the filamentous fungal cell. The targeting peptide may be N-terminal or C-terminal to the catalytic domains. In certain embodiments, the targeting peptide is N-terminal to the catalytic domains. In certain embodiments, the targeting peptide provides direct binding to the ER or Golgi membrane. Components of the targeting peptide may come from any enzyme that normally resides in the ER or Golgi apparatus. Such enzymes include mannosidases, mannosyltransferases, glycosyltransferases, Type 2 Golgi proteins, and MNN2, MNN4, MNN6, MNN9, MNN10, MNS1, KRE2, VAN1, and OCH1 enzymes. Suitable targeting peptides are described in the International Patent Application No. PCT/EP2011/070956. In one embodiment, the targeting peptide of GnTI or GnTII is human GnTII enzyme. In other embodiments, targeting peptide is derived from *Trichoderma* Kre2, Kre2-like, Och1, Anp1, and Van1. In one embodiment, the targeting peptide is selected from the group of SEQ ID NOs: 589-594.

Uses of the Filamentous Fungal Cells of the Invention

The invention herein further relates to methods of using any of the filamentous fungal cells of the present disclosure, such as *Trichoderma* fungal cells, that have reduced or no protease activity of at least three proteases and that contain a recombinant polynucleotide encoding a heterologous polypeptide, such as a mammalian polypeptide, that is produced at increased levels, for improving heterologous polypeptide stability and for making a heterologous polypeptide. Methods of measuring protein stability and for making a heterologous polypeptide are well known, and include, without limitation, all the methods and techniques described in the present disclosure.

Accordingly, certain embodiments of the present disclosure relate to methods of improving heterologous polypeptide stability, by: a) providing a filamentous fungal cell of the present disclosure having reduced or no activity of at least three proteases, where the cell further contains a recombinant polynucleotide encoding a heterologous polypeptide; and b) culturing the cell such that the heterologous polypeptide is expressed, where the heterologous polypeptide has increased stability compared to a host cell not containing the mutations of the genes encoding the proteases. Other embodiments of the present disclosure relate to methods of improving mammalian polypeptide stability, by: a) providing a *Trichoderma* fungal cell of the present disclosure having reduced or no activity of at least three proteases, where the cell further contains a recombinant polynucleotide encoding a mammalian polypeptide; and b) culturing the cell such that the mammalian polypeptide is expressed, where the mammalian polypeptide has increased stability compared to a host cell not containing the mutations of the genes encoding the proteases. The filamentous fungal cell or *Trichoderma* fungal cell may be any cell described in the section entitled "Filamentous Fungal Cells of the Invention". Methods of measuring polypeptide stability and for culturing filamentous fungal and *Trichoderma* fungal cells are well known in the art, and include, without limitation, all the methods and techniques described in the present disclosure.

In certain embodiments, the stability of the heterologous polypeptide or mammalian polypeptide is increased by at least 2-fold, at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 30-fold, at least 40-fold, at least 50-fold, at least 60-fold, at least 70-fold, at least 75-fold, at least 80-fold, at least 90-fold, at least 100-fold, or a greater fold higher compared to a heterologous polypeptide or mammalian polypeptide expressed in a corresponding parental filamentous fungal or *Trichoderma* fungal cell.

Other embodiments of the present disclosure relate to methods of making a heterologous polypeptide, by: a) providing a filamentous fungal cell of the present disclosure having reduced or no activity of at least three proteases, where the cell further contains a recombinant polynucleotide encoding a heterologous polypeptide; b) culturing the host cell such that the heterologous polypeptide is expressed; and c) purifying the heterologous polypeptide. Further embodiments of the present disclosure relate to methods of making a mammalian polypeptide, by: a) providing a *Trichoderma* fungal cell of the present disclosure having reduced or no activity of at least three proteases, where the cell further contains a recombinant polynucleotide encoding a mammalian polypeptide; b) culturing the host cell such that the mammalian polypeptide is expressed; and c) purifying the mammalian polypeptide. The filamentous fungal cell or Trichoderma fungal cell may be any cell described in the section entitled "Filamentous Fungal Cells of the Invention". Methods of culturing filamentous fungal and Trichoderma fungal cells and purifying polypeptides are well known in the art, and include, without limitation, all the methods and techniques described in the present disclosure.

In certain embodiments, the filamentous fungal cell or Trichoderma fungal cell is cultured at a pH range selected from pH 3.5 to 7; pH 3.5 to 6.5; pH 4 to 6; pH 4.3 to 5.7; pH 4.4 to 5.6; and pH 4.5 to 5.5. In certain embodiments, to produce an antibody the filamentous fungal cell or Trichoderma fungal cell is cultured at a pH range selected from 4.7 to 6.5; pH 4.8 to 6.0; pH 4.9 to 5.9; and pH 5.0 to 5.8.

In some embodiments, the heterologous polypeptide is a mammalian polypeptide. In other embodiments, the heterologous polypeptide is a non-mammalian polypeptide.

In certain embodiments, the mammalian polypeptide is selected from an immunoglobulin, immunoglobulin heavy chain, an immunoglobulin light chain, a monoclonal antibody, a hybrid antibody, an F(ab')2 antibody fragment, an F(ab) antibody fragment, an Fv molecule, a single-chain Fv antibody, a dimeric antibody fragment, a trimeric antibody fragment, a functional antibody fragment, a single domain antibody, multimeric single domain antibodies, an immunoadhesin, insulin-like growth factor 1, a growth hormone, insulin, and erythropoietin. In other embodiments, the mammalian protein is an immunoglobulin or insulin-like growth factor 1. In yet other embodiments, the mammalian protein is an antibody. In further embodiments, the yield of the mammalian polypeptide is at least 0.5, at least 1, at least 2, at least 3, at least 4, or at least 5 grams per liter. In certain embodiments, the mammalian polypeptide is an antibody, optionally, IgG1, IgG2, IgG3, or IgG4. In further embodiments, the yield of the antibody is at least 0.5, at least 1, at least 2, at least 3, at least 4, or at least 5 grams per liter. In still other embodiments, the mammalian polypeptide is a growth factor or a cytokine. In further embodiments, the yield of the growth factor or cytokine is at least 0.1, at least 0.2, at least 0.3, at least 0.4, at least 0.5, at least 1, at least 1.5, at least 2, at least 3, at least 4, or at least 5 grams per liter. In further embodiments, the mammalian polypeptide is an antibody, and the antibody contains at least 70%, at least 80%, at least 90%, at least 95%, or at least 98% of a natural antibody C-terminus and N-terminus without additional amino acid residues. In other embodiments, the mammalian polypeptide is an antibody, and the antibody contains at least 70%, at least 80%, at least 90%, at least 95%, or at least 98% of a natural antibody C-terminus and N-terminus that do not lack any C-terminal or N-terminal amino acid residues In certain embodiments where the mammalian polypeptide is purified from cell culture, the culture containing the mammalian polypeptide contains polypeptide fragments that make up a mass percentage that is less than 50%, less than 40%, less than 30%, less than 20%, or less than 10% of the mass of the produced polypeptides. In certain preferred embodiments, the mammalian polypeptide is an antibody, and the polypeptide fragments are heavy chain fragments and/or light chain fragments. In other embodiments, where the mammalian polypeptide is an antibody and the antibody purified from cell culture, the culture containing the antibody contains free heavy chains and/or free light chains that make up a mass percentage that is less than 50%, less than 40%, less than 30%, less than 20%, or less than 10% of the mass of the produced antibody. Methods of determining the mass percentage of polypeptide fragments are well known in the art and include, measuring signal intensity from an SDS-gel.

In further embodiments, the non-mammalian polypeptide is selected from an aminopeptidase, amylase, carbohydrase, carboxypeptidase, catalase, cellulase. chitinase, cutinase, deoxyribonuclease, esterase, alpha-galactosidase, beta-galactosidase, glucoamylase, alpha-glucosidase, beta-glucosidase, invertase, laccase, lipase, mutanase, oxidase, pectinolytic enzyme, peroxidase, phospholipase, phytase, polyphenoloxidase, proteolytic enzyme, ribonuclease, transglutaminase, and xylanase.

In certain embodiments of any of the disclosed methods, the method includes the further step of providing one or more, two or more, three or more, four or more, or five or more protease inhibitors. In certain embodiments, the protease inhibitors are peptides that are co-expressed with the mammalian polypeptide. In other embodiments, the inhibitors inhibit at least two, at least three, or at least four proteases from a protease family selected from aspartic proteases, trypsin-like serine proteases, subtilisin proteases, and glutamic proteases.

In certain embodiments of any of the disclosed methods, the filamentous fungal cell or Trichoderma fungal cell also contains a carrier protein. As used herein, a "carrier protein" is portion of a protein that is endogenous to and highly secreted by a filamentous fungal cell or Trichoderma fungal cell. Suitable carrier proteins include, without limitation, those of T. reesei mannanase I (Man5A, or MANI), T. reesei cellobiohydrolase II (Cel6A, or CBHII) (see, e.g., Paloheimo et al Appl. Environ. Microbiol. 2003 December; 69(12): 7073-7082) or T. reesei cellobiohydrolase I (CBHI). In some embodiments, the carrier protein is CBHI. In other embodiments, the carrier protein is a truncated T. reesei CBHI protein that includes the CBHI core region and part of the CBHI linker region. In some embodiments, a carrier such as a cellobiohydrolase or its fragment is fused to an antibody light chain and/or an antibody heavy chain. In some embodiments, a carrier such as a cellobiohydrolase or its fragment is fused to insulin-like growth factor 1, growth hormone, insulin, interferon alpha 2b, fibroblast growth factor 21, or human serum albumin. In some embodiments, a carrier-antibody fusion polypeptide comprises a Kex2 cleavage site. In certain embodiments, Kex2, or other carrier cleaving enzyme, is endogenous to a filamentous fungal cell. In certain embodiments, carrier cleaving protease is heterologous to the filamentous fungal cell, for example, another Kex2 protein derived from yeast or a TEV protease. In certain embodiments, carrier cleaving enzyme is overexpressed.

It is to be understood that, while the invention has been described in conjunction with the certain specific embodiments thereof, the foregoing description is intended to illustrate and not limit the scope of the invention. Other aspects, advantages, and modifications within the scope of the invention will be apparent to those skilled in the art to which the invention pertains.

The invention having been described, the following examples are offered to illustrate the subject invention by way of illustration, not by way of limitation.

EXAMPLES

Example 1—Identification of Aspartic Proteases in Trichoderma Reesei

This example demonstrates the ability of aspartic proteases from Trichoderma reesei (T. reesei) culture supernatants to degrade antibody heavy chains and light chains.

Aspartic Protease Purification

It was found that protease activity in *T. reesei* supernatants could be inhibited with the aspartic protease inhibitor pepstatin A. Therefore, pepstatin A (Sigma #P2032) was attached to agarose beads via a diaminodipropylamine linker, and was used as an affinity resin for purification. The *T. reesei* fed batch fermentation supernatant (15 ml) was used to batch bind proteases to the resin in 35 ml of buffer containing 50 mM sodium acetate, 0.2 M NaCl, pH 3.0. The column was washed with the same binding buffer and bound protein was removed with elution buffer (50 mM Tris-HCL, 1 M NaCl, pH 8.5). Fractions of 0.5 ml were collected. In total 42 µg of protease was purified. The peak fraction contained 0.04 µg/µl protein. 30 µl of each fraction was mixed with 6 µl of Laemmli sample buffer containing β-mercaptoethanol. The samples were heated at 95° C. for 5 minutes before being loaded into a 4-15% PAGE gel (Bio-Rad mini-protean TGX precast gel) along with a broad range prestained molecular weight marker (BioRad). The gel was run in SDS PAGE running buffer for 30 minutes at 100 V, and then stained with GelCode (Thermo Scientific) blue stain.

A 42 kD doublet band was purified in the pepstatin A affinity column (FIG. 1), and was excised from the SDS PAGE gel and subjected to in-gel trypsin digestion with sequencing grade modified trypsin (Promega #V5111). The resulting peptides were then extracted from the gel and purified by CI 8 ZipTip (Millipore #ZTC18M096). The purified peptides were analyzed by LC-MS/MS on a QSTAR Pulsar, ESI-hybrid quadrupole-TOF (AB Sciex).

This analysis resulted in the identification of 4 aspartic proteases that have very similar molecular weights. The identified proteases included: pep1 (Tre74156; 42.7 kD, 42% sequence coverage), pep2 (Tre53961; 42.4 kD, 15% sequence coverage), pep3 (Tre121133; 49 kD, 6% sequence coverage), and pep5 (Tre81004; 45 kD, 9% sequence coverage). These aspartic proteases ran at a similar molecular weight in the PAGE gel. Their amino acid sequence similarity is between 51%-64%.

Figure 2:
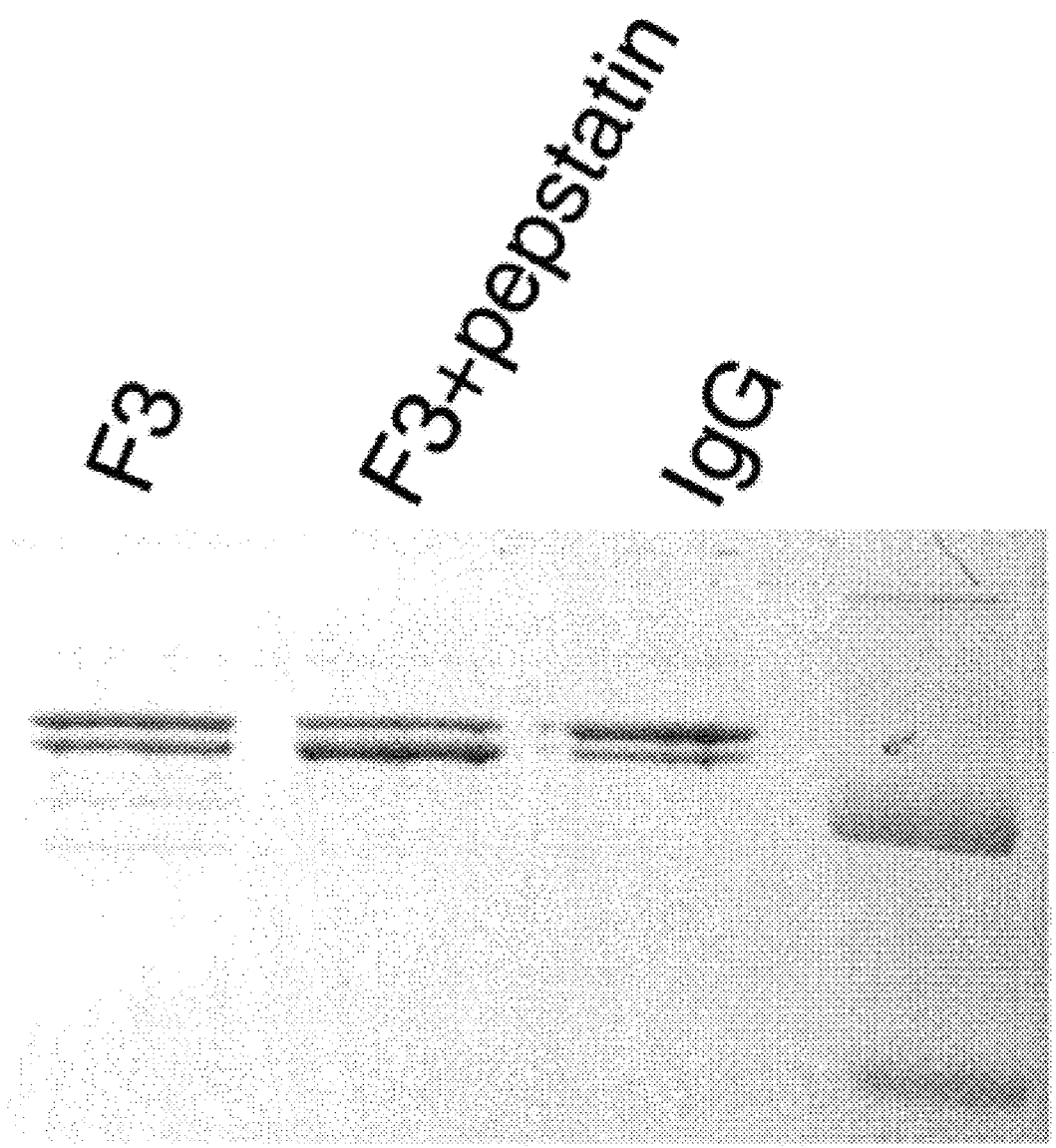
FIG. 2 depicts a PAGE gel showing the results of incubating IgG with aspartic proteases.

Protein (0.8 µg) from the peak fraction (F3) was then incubated with IgG (50 µg ml) in sodium citrate buffer (50 mM, pH 5.5) at 37° C. for 20 hours (FIG. 2). The protein was incubated either in the presence or absence of 10 µM pepstatin A. The antibody mixture was combined with Laemmli sample buffer and heated at 95° C. for 5 minutes. These samples were then loaded into a 4-15% PAGE gel (BioRad mini-protean TGX precast gel) along with a broad range prestained molecular weight marker (BioRad). The gel was run in SDS PAGE running buffer for 30 minutes at 100 V. The IgG was not reduced before being run on the gel. Full size IgG runs just above the 200 kDa marker. As can be seen in the nonreducing gel in FIG. 2, the aspartic proteases were able to produce mild degradation of the IgG. Moreover, IgG degradation was inhibited by pepstatin A. The aspartic protease activity was more limited at pH 5.5 than at acidic pHs, where they had maximal activity.

Analysis of Pep1 Deletion

The aspartic protease pep1 protease was then tested to determine its abundance in *T. reesei*. This was performed by purifying aspartic proteases from supernatant samples derived from the pep1 deletion strain M182. The M182 pep1 deletion strain also produces the rituximab antibody.

Figure 39A:
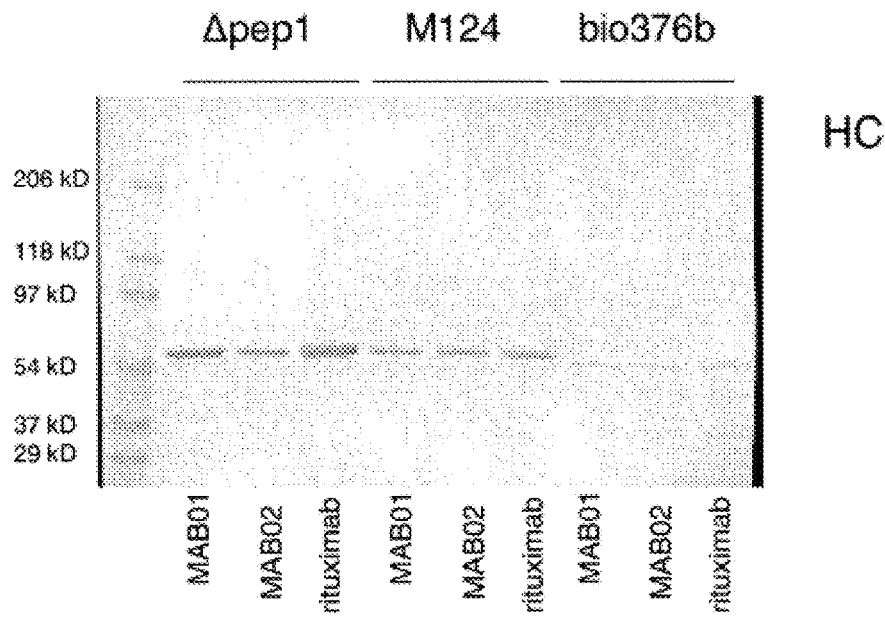
FIG. 39A and FIG. 39B depicts an immunoblot showing improved the stability of antibody heavy (HC (FIG. 39A)) and light chain (LC (FIG. 39B)) from *T. reesei* cells containing a deletion of the pep1 protease. Three model antibodies were tested in large shake flask supernatant (Apep1 and M124) and fermentation supernatant (pH 5.5; 28° C.; 20 g/L spent grain extract, 60 g/L lactose).
Figure 39B:
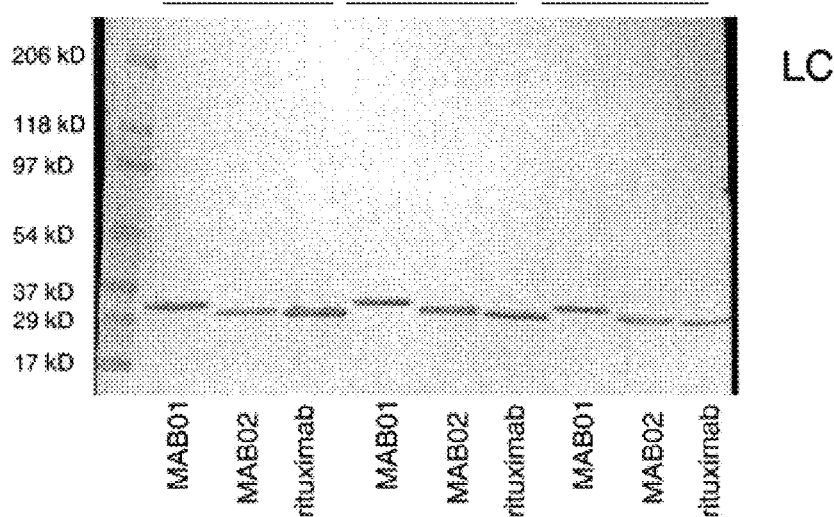

The M181 pep1 deletion strain made in the base strain M124 was grown in large shake flask cultures along with M124 control flasks. The cultures were grown in 300 ml of TrMM with 4 g/L lactose, 2 g/L spent grain extract, and 100 mM PIPPS, pH 5.5. Three different model antibodies were incubated (0.05 µg µl final concentration) in the shake flask culture supernatants (diluted 2 mg/ml in sodium citrate buffer pH 5.5) of the pep1 deletion strain and its parental strain M124, and as a comparison in a fermentation culture supernatant of the parental strain. Supernatant samples (30 µl) from day 5 cultures containing antibody were loaded into a 4-15% SDS PAGE gel and transferred to nitrocellulose for immunoblotting with an anti-heavy chain AP conjugated antibody (Sigma #A3188) or anti-light chain antibody AP conjugate (Sigma #A3813) diluted 1:30,000 in TBST. When incubated with antibody overnight for 18 hours, the Δpep1 supernatant degraded less of the heavy chain protein as compared to the M124 control strain or fermentation supernatant (pH 5,5; 28° C.; 20 g/L spent grain extract, 60 g/L lactose) (FIG. 39). The heavy chain was more susceptible to degradation as compared to the light chain. The biggest stabilization effect was evident for rituximab and MAB01 heavy chains. In the heavy chain, two distinct degradation products can be seen −48 kD and −38 kD (FIG. 39). There was only a slight improvement in the stability of light chain protein in the Δpep1 supernatant as compared to controls (FIG. 39).

Generation of Pep 1 Deletion Plasmid

The first deletion construct for pep1 (TreID74156), was designed to enable removal of the selection marker from the *Trichoderma reesei* genome after successful integration and thereby recycling of the selection marker for subsequent protease gene deletions. In this approach, the recycling of the marker, i.e. removal of pyr4 gene from the deletion construct, resembles so called blaster cassettes developed for yeasts (Hartl, L. and Seiboth, B., 2005, Curr Genet 48:204-211; and Alani, E. et al., 1987, Genetics 116:541-545). Similar blaster cassettes have also been developed for filamentous fungi including *Hypocrea jecorina* (anamorph: *T. reesei*) (Hartl, L. and Seiboth, B., 2005, Curr Genet 48:204-211).

The TreID number refers to the identification number of a particular protease gene from the Joint Genome Institute *Trichoderma reesei* v2.0 genome database. Primers for construction of deletion plasmids were designed either "by eye" or using Primer3 software (Primer3 website, Rozen and Skaletsky (2000) Bioinformatics Methods and Protocols: Methods in Molecular Biology. Humana Press, Totowa, N.J., pp 365-386).

The principle of the blaster cassette using pyr4 as the marker gene is as follows: pyr4, encoding orotidine-5'-monophosphate (OMP) decarboxylase of *T. reesei* (Smith, J. L., et al., 1991, Current Genetics 19:27-33) is needed for uridine synthesis. Strains deficient for OMP decarboxylase activity are unable to grow on minimal medium without uridine supplementation (i.e. are uridine auxotrophs). The utilisation of 5-fluoroorotic acid (5-FOA) in generation of mutant strains lacking OMP decarboxylase activity (pyr4⁻ strains) is based on the conversion of 5-FOA to a toxic intermediate 5-fluoro-UMP by OMP decarboxylase. Therefore, cells which have a mutated pyr4 gene are resistant to 5-FOA, but in addition are also auxotrophic for uridine. The 5-FOA resistance can in principle result also from a mutation in another gene (pyr2, orotate phosphoribosyltransferase), and therefore the spontaneous mutants obtained with this selection need to be verified for the pyr4⁻ genotype by complementing the mutant with the pyr4 gene. Once mutated, the pyr4 gene can be used as an auxotrophic selection marker in *T. reesei*. In our blaster cassette pyr4 is followed by a 308 bp direct repeat of pyr4 5' untranslated region (5'UTR) and surrounded by 5' and 3' flanking regions of the gene to be deleted. Integration of the deletion cassette is selected via the pyr4 function. Removal of the pyr4 marker is then forced in the presence of 5-FOA by recombination between the two homologous regions (direct repeat of 5'UTR) resulting in looping out of the selection marker and enabling the utilisation of the same blaster cassette (pyr4 loopout) in successive rounds of gene deletions. After looping out only the 308 bp sequence of 5'UTR remains in the locus.

Thus, the pyr4 selection marker and the 5' direct repeat fragment (308 bp of pyr4 5'UTR) were produced by PCR using plasmid pARO502 (containing a genomic copy of *T. reesei* pyr4) as a template. PCR amplification was performed with Phusion polymerase and either HF buffer or GC buffer, or with Dynazyme EXT polymerase. The reaction conditions varied based on the fragment being amplified. Both fragments contained 40 bp overlapping sequences needed to clone the plasmid with the loopout cassette using homologous recombination in yeast (see below). To enable possible additional cloning steps, an AscI digestion site was placed between the pyr4 marker and the 5' direct repeat and NotI sites to surround the complete blaster cassette.

1066 bp of 5' flanking region and 1037 bp of 3' flanking region were selected as the basis of the pep1 deletion plasmid. Fragments were produced by PCR. Products were separated with agarose gel electrophoresis and correct fragments were isolated from the gel with a gel extraction kit (Qiagen) using standard laboratory methods. Template DNA used in the amplification of the flanking regions was from the *T. reesei* wild type strain QM6a (ATCC13631).

For the yeast homologous recombination system used in cloning, overlapping sequences for the vector and the selection marker were placed to the appropriate PCR-primers. To enable marker switch in the construct, NoiI restriction sites were introduced between the flanking regions and the selection marker. PmeI restriction sites were placed between the vector and the flanking regions for removal of vector sequence prior to transformation into *T. reesei*. Vector backbone pRS426 was digested with restriction enzymes (EcoRI and XhoI). The restriction fragments were then separated with agarose gel electrophoresis, and the correct fragments were isolated from the gel with a gel extraction kit (Qiagen) using standard laboratory methods.

To construct the deletion plasmid, the vector backbone and the appropriate marker and flanking region fragments were transformed into *Saccharomyces cerevisiae* (strain H3488/FY834). The yeast transformation protocol was based on the method for homologous yeast recombination described in the *Neurospora* knockouts workshop material of Colot and Collopy, (Dartmouth *Neurospora* genome protocols website), and the Gietz laboratory protocol (University of Manitoba, Gietz laboratory website). The plasmid DNA from the yeast transformants was rescued by transformation into *Escherichia coli*. A few clones were cultivated, plasmid DNA was isolated and digested to screen for correct recombination using standard laboratory methods. A few clones with correct insert sizes were sequenced and stored.

The first deletion plasmid for pep1 (plasmid pTTv41, Table 1.1) used another selection marker, bar, a synthetic construct carrying a phosphinothricin N-acetyltransferase of *Streptomyces* ssp (GenBank ID: AF013602.1, Sweigard et al, 1997, Fungal Genet Newsl 44:52-53). The flanking region and marker fragments were produced by PCR and assembled to a plasmid using the yeast recombination method described above. To clone the second pep1 deletion plasmid (pTTv71, Table 1.1), the bar marker was removed from the deletion plasmid pTTv41 with NotI digestion and replaced by the pyr4 blaster cassette described above using the yeast homologous recombination system. These deletion plasmids for pep1 (pTTv41 and pTTv71) result in 1874 bp deletion in the pep1 locus and cover the complete coding sequence of PEP1.

TABLE 1.1

Primers for generating pep1 deletion plasmids.

Deletion plasmid pTTv41 for pep1 (TreID74156), vector backbone pRS426

| Primer | Sequence |
|---|---|
| 5flankfw | GTAACGCCAGGGTTTTCCCAGTCACGACGGTTTAAACGTATTGCGATGAGCAGC AGA (SEQ ID NO: 243) |
| 5flankrev | ATCCACTTAACGTTACTGAAATCTGGTCTCCTAACCCACCAAG (SEQ ID NO: 244) |
| 3flankfw | CTCCTTCAATATCATCTTCTGTCTGTGAAATGAGGTCCCTTCC (SEQ ID NO: 245) |
| 3flankrev | GCGGATAACAATTTCACACAGGAAACAGCGTTTAAACCAAACGCAGCAGAAAC CATA (SEQ ID NO: 246) |
| PTfwd | GATTTCAGTAACGTTAAGTGGATGCGGCCGCGACAGAAGATGATATTGAAG (SEQ ID NO: 247) |
| PTrev | GACAGAAGATGATATTGAAGGAGGCOGCCGCTTAAGTGGATCCCGGTGAC (SEQ ID NO: 248) |

Deletion plasmid pTTv71 for pep1 (TreID74156), vector backbone pTTv41

| Primer | Sequence |
|---|---|
| T315_pyr4_for | GGTGGGTTAGGAGACCAGATTTCAGTAACGTTAAGTGGATGCGGCCGCCTAGC ATCGACTACTGCTGC (SEQ ID NO: 249) |
| T316_pyr4_rev | GCAGCAGTAGTCGATGCTAGGCGCGCCATGCAAAGATACACATCAA (SEQ ID NO: 250) |
| T317_pyr4_loop_for | TTGATGTGTATCTTTGCATGGCGCGCCTAGCATCGACTACTGCTGC (SEQ ID NO: 251) |
| T318_pyr4_loop_rev | AGGGACCTCATTTCACAGACAGAAGATGATATTGAAGGAGGCGGCCGCGGCTG ATGAGGCTGAGAGAG (SEQ ID NO: 252) |

Generation of Pep1 Deletion Strains M1 81 and M1 95

To enable recycling of the selection marker and allow rapid deletion of subsequent protease genes, pep1 was deleted from M127 (pyr4− mutant of the basic strain M124) using the pyr4 blaster cassette described above. To remove the vector sequence, plasmid pTTv71 (Δpep1-pyr4) was digested with PmeI and the correct fragment was purified from an agarose gel using QIAquick Gel Extraction Kit (Qiagen). Approximately 5 µg of the pep1 deletion cassette was used to transform strain M127. Preparation of protoplasts and transformation for pyr4 selection were carried out essentially according to methods in Penttila et al. (1987, Gene 61: 155-164) and Gruber et al (1990, Curr. Genet. 18:71-76).

Figure 3A:
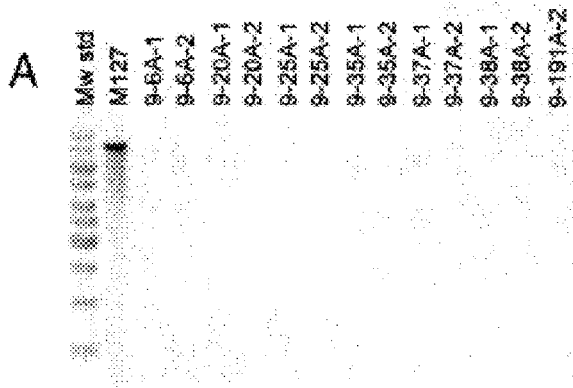
FIGS. 3A-C depictSouthern blot analysis showing the generation of single protease deletion strains M181 and M195. M181=repurified clone 9-20A-1 (i.e. originating from 9-20A). M195=repurified clone 935A-1 (i.e. originating from 9-35A).
Figure 3B:
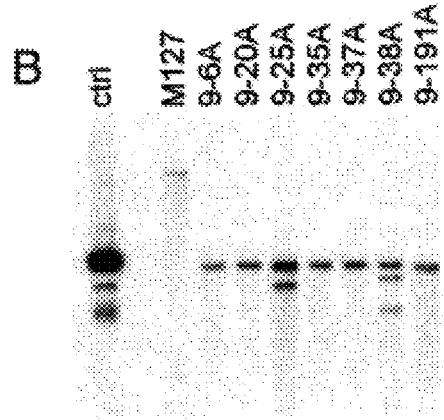
Figure 3C:
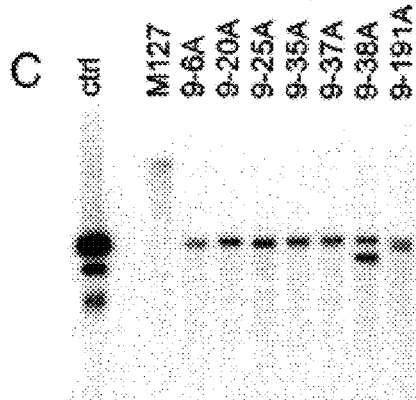

200 clones were picked as selective streaks. 24 transformants growing fast as selective streaks were screened by PCR using the primers listed in Table 1.2 for the correct integration using standard laboratory methods. Seven putative disruptants were purified to single cell clones. Deletion of pep1 was verified by Southern analyses from these clones (FIG. 3A) using standard laboratory methods. DNA for Southern analyses was extracted with Easy-DNA kit for genomic DNA isolation (Invitrogen). Southern analyses were essentially performed according to the protocol for homologous hybridizations in Sambrook et al. (1989, Molecular Cloning: A laboratory manual. 2$^{nd}$ Ed., Cold Spring Harbor Laboratory Press) using radioactive labeling (32P), HexaLabel Plus, or DecaLabel Plus kits (Fermentas). Southern digestion schemes were designed using either Sci Ed Central for Windows 95 (Clone Manager 5 for Windows 95) or Geneious Pro 5.3.6 software, (Geneious website). Southern analyses also verified that four of the clones were single integrants (FIGS. 3B and 3C). Three clones indicated multiple or inaccurate integration of the deletion cassette and were discarded. Two pure clones were designated with strain numbers M181 (9-20A-1) and M195 (9-35A-1).

Generation of Rituximab Producing Pep1 Deletion Strain M182

To remove vector sequence, plasmid pTTv41 (Δpep1-bar) was digested with PmeI and the correct fragment was purified from agarose gel using QIAquick Gel Extraction Kit (Qiagen). Approximately 5 µg of the pep1 deletion cassette was used to transform strain M169 (expressing harmonized rituximab antibody). Preparation of protoplasts and transformation were carried out according to methods described in Penttila et al (1987) and Avalos et al. (1989).

Figure 4A:
FIGS. 4A-C depict Southern blot analysis showing the generation of rituximab antibody in the pep1 deletion strain M182. M182=11-1A. M169, parent=Rx25A_1.
Figure 4B:
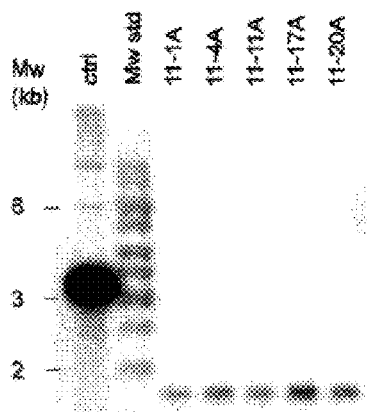
Figure 4C:
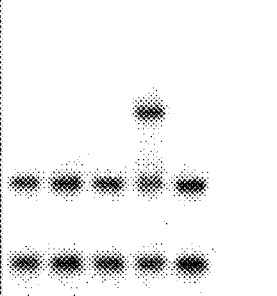

Approximately 100 clones were picked as selective streaks. 24 transformants growing fast as selective streaks were screened by PCR (using the primers listed in Table 1.2) for the correct integration using standard laboratory methods. Eight putative disruptants were purified to single cell clones. Deletion of pep1 was verified by Southern analyses from five clones (FIG. 4A) using standard laboratory methods described above for M181 and M195. Southern analyses also verified that four of the clones were single integrants (FIGS. 4B and 4C). One clone indicated multiple or inaccurate integration of the deletion cassette and was discarded. One pure clone (11-1A) was designated with strain number M182.

TABLE 1.2

Primers for screening integration of pep1 deletion constructs.

| | |
|---|---|
| T075_74156_5int | TCGCTGTAACGAACTTCTGT SEQ ID NO: 253) |
| T032_Bar_loppu_for | CATTGTTGACCTCCACTAGC (SEQ ID NO: 254) |
| T076_74156_3int | GCTGCTGATCGGACATTTTT (SEQ ID NO: 255) |
| T031_Bar_alku_rev2 | GTTTCTGGCAGCTGGACT (SEQ ID NO: 256) |

TABLE 1.2-continued

Primers for screening integration of pep1 deletion constructs.

For screening integration of pTTv71

| Primer | Sequence |
|---|---|
| T075_74156_5int | TCGCTGTAACGAACTTCTGT (SEQ ID NO: 257) |
| T027_Pyr4_orf_start_rev | TGCGTCGCCGTCTCGCTCCT (SEQ ID NO: 258) |

For screening deletion of pep1 ORF

| Primer | Sequence |
|---|---|
| T077_74156_5orf_pcr | CGACGATCTACAGCCATCTG (SEQ ID NO: 259) |
| T078_74156_3orf_pcr | ACCCAAAGCGTCCTTCATTA (SEQ ID NO: 260) |

For screening integration of pTTv41

| Primer | Sequence |
|---|---|

Analysis of Rituximab Producing Pep1 Deletion Strain M182

Figure 5:
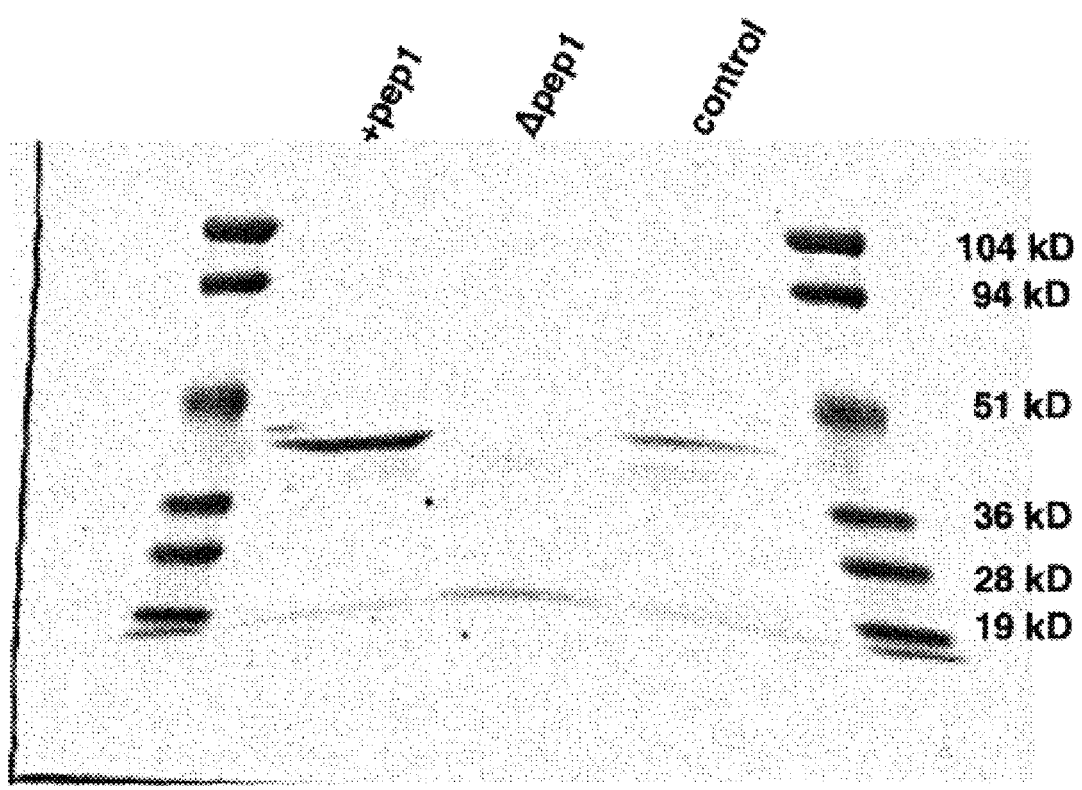
FIG. 5 depicts a protein gel showing peak fractions from aspartic protease purifications of a pep1 containing strain and Δpep1 strain.

The M182 strain was grown in *Trichoderma* minimal medium (TrMM) supplemented with 20 g/l spent grain extract, 60 g/l lactose, and 8.1 g/l casamino acids at pH 5.5 and 28° C. Seven microgram of aspartic protease was recovered from 15 ml of supernatant. When the purified fractions were run on a 4-15% SDS PAGE gel (BioRad mini-protean TGX precast gel), the 42 kD molecular weight band previously seen in the parent strain had disappeared (FIG. 5). Only a faint band around 40 kD could be seen. The 40 kD band may correspond to minor aspartic proteases. A second purification was done from a cultivation supernatant where pep1 was present. The M1 69 strain produced rituximab and did not contain a pep1 protease deletion. The strain was grown in *Trichoderma* minimal medium supplemented with 20 g/l spent grain extract, 60 g/l lactose, and 8.1 g/l casamino acids at pH 5.5 and 28° C. 17 µg of aspartic protease were purified from 15 ml of supernatant, and showed a 42 kD band on the SDS PAGE gel (FIG. 5). According to this analysis, approximately 10 µg of pep1 protease is produced per 15 ml of culture supernatant. That is about 60% of the total aspartic protease and only about 0.04% of total protein content in the supernatant. This data demonstrates that pep1 is the most abundant aspartic protease in *T. reesei*.

Analysis of Other Aspartic Proteases

Figure 6B:
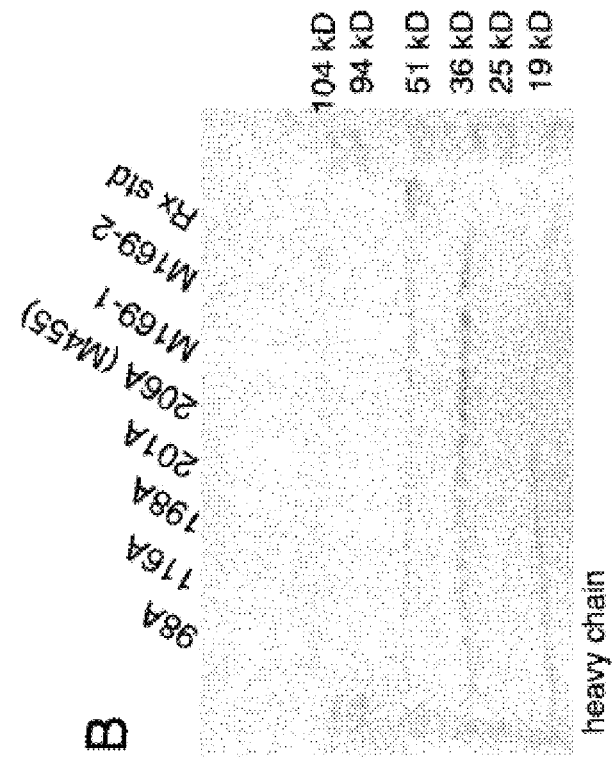
FIGS. 6A-B depict an immunoblot illustrating that deleting pep2 protease from the rituximab production strain M1 69 improved the (FIG. 6A) light and (FIG. 6B) heavy chain production in transformant 206A (strain M455). The bands representing the light chain fragment at 18 kD and the heavy chain fragment at 38 kD were more intense in strain M455 compared to the parent strain M169.
Figure 6A:
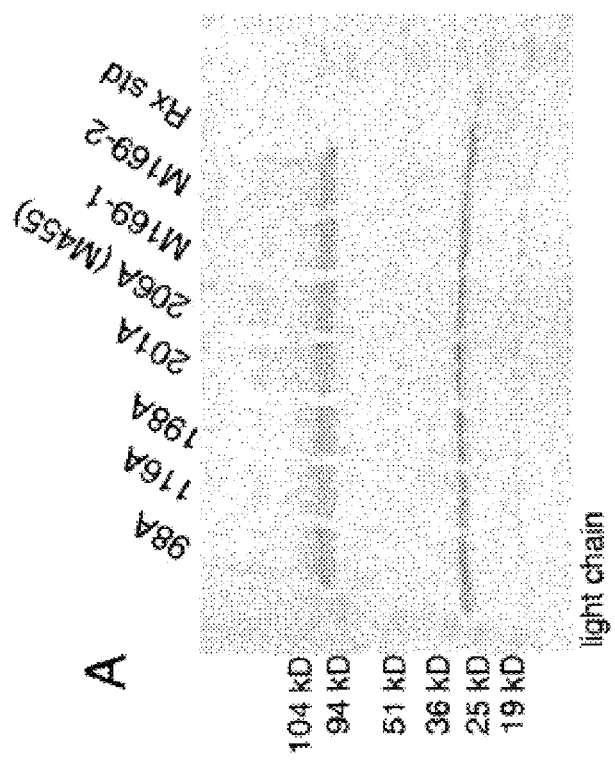
Figure 7:
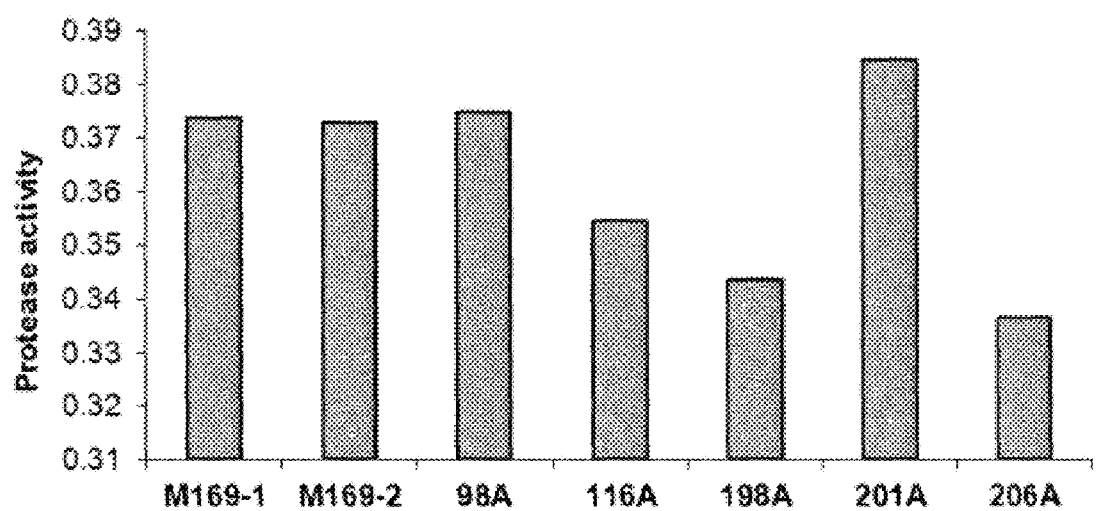
FIG. 7 graphically depicts the protease activity of supernatant from the rituximab production strain M169 and the pep2 protease deletion transformants 98A, 116A, 198A, 201 A, and 206A (M455). Transformants 116A, 198A, and 206A show reduced protease activity against casein compared to their parent strain M169.

Deletion of pep2 showed only a slight improvement in antibody heavy chain production and reduced total protease activity (FIGS. 6 and 7).

Therefore, pep3 and pep5 were the next important proteases to be deleted especially in a pep1/tsp1/slp1 triple deletion strain, as they still contribute up to half of the remaining protease activity in a triple deletion strain supernatant.

Generation of Pep2 Deletion Plasmid

The pTTv96 deletion plasmid for the aspartic protease pep2 (TreID0053961) was constructed essentially as described for the pTTv41 pep1 deletion plasmid above. 920 bp of 5' flanking region and 1081 bp of 3' flanking region were selected as the basis of the pep2 deletion plasmid. Flanking region fragments were produced by PCR using the primers listed in Table 1.3. The products were separated with agarose gel electrophoresis and the correct fragments were isolated from the gel with gel extraction kit (Qiagen) using standard laboratory methods. Template DNA used in the PCR of the flanking regions was from the *T. reesei* wild type strain QM6a. The bar cassette was obtained from pTTv41 with NotI digestion. The vector backbone was EcoRI/XhoI digested pRS426 as for pTTv41 above. The plasmid was constructed using the yeast homologous recombination method described for pTTv41 above. This deletion plasmid for pep2 (pTTv96) results in a 1437 bp deletion in the pep2 locus and covers the complete coding sequence of PEP2.

TABLE 1.3

Primers for generating pep2 deletion plasmid.

| Primer | Sequence |
| --- | --- |
| 5'flank fw_vector | GTAACGCCAGGGTTTTCCCAGTCACGAC GGTTTAAACTTCAGTTGTGGCATCTCAG C (SEQ ID NO: 261) |
| 5'flank rev_marker cassette promoter | GCCAAGCCCAAAAAGTGCTCCTTCAATA TCATCTTCTGTCGCGGCCGCGGGAAGCA AGTTTCGAAGTG (SEQ ID NO: 262) |
| 3'flank fw_marker cassette end | CCCGTCACCGAGATCTGATCCGTCACCG GGATCCACTTAAGCGGCCGCAATGGATG AGGTGTGGCTTC (SEQ ID NO: 263) |
| 3'flank rev_vector | GCGGATAACAATTTCACACAGGAAACAG CGTTTAAACTCCTCACCGAAGAGCAAGT C (SEQ ID NO: 264) |

Generation of Rituximab Producing Pep2 Deletion Strain M455

To remove vector sequence, plasmid pTTv96 (Δpep2-bar) was digested with PmeI and the correct fragment was purified from an agarose gel using QIAquick Gel Extraction Kit (Qiagen). Approximately 6 μg of the pep2 deletion cassette was used to transform strain M169 (expressing harmonized rituximab antibody). Preparation of protoplasts and transformation were carried out as described for M182 above using bar selection.

Over 200 clones were picked as selective streaks. 29 transformants grew well as second streaks. The best 10 transformants growing fast as selective streaks were screened for the correct integration by PCR, using the primers listed in Table 1.4, using standard laboratory methods. The deletion cassette was integrated properly in 9 of the 10 clones analyzed. The open reading frame was deleted in 9 of the 10 transformants analyzed by PCR. Five disruptants were purified to single cell clones. One pure transformant (206A) was designated with strain number M455.

TABLE 1.4

Primers for screening integration of pep2 deletion constructs.

| For screening integration of pTTv96 | |
| --- | --- |
| Primer | Sequence |
| 5'flank fw_vector | GTAACGCCAGGGTTTTCCCAGTCAC GACGGTTTAAACTTCAGTTGTGGCA TCTCAGC (SEQ ID NO: 265) |
| T032_Bar_loppu_for | CATTGTTGACCTCCACTAGC (SEQ ID NO: 266) |
| T030_Bar_alku_rev | CGTCACCGAGATCTGATCC (SEQ ID NO: 267) |

TABLE 1.4-continued

Primers for screening integration of pep2 deletion constructs.

| 3'flank rev_vector | GCGGATAACAATTTCACACAGGAAA CAGCGTTTAAACTCCTCACCGAAG AGCAAGTC (SEQ ID NO: 268) |
| --- | --- |

| For screening deletion of pep2 ORF | |
| --- | --- |
| Primer | Sequence |
| T601_pep2 fwd | GACGTGGTACGACAACATCG (SEQ ID NO: 269) |
| T623_pep2 rev | TATCAAGGTACCGGGACAG (SEQ ID NO: 270) |

Analysis of Rituximab Producing Pep2 Deletion Strain

The M455 strain, 4 other pep2 deletion transformants, and the parental rituximab production strain M169 were grown in shake flask cultures in *Trichoderma* minimal medium (TrMM) supplemented with 20 g/l spent grain extract, 40 g/l lactose, 100 mM PIPPS, and 8.1 casamino acids at pH 5.5 and 28° C. To analyze the effect on rituximab production, 30 μl of supernatant from the day 5 culture samples was subjected to immunoblotting. The heavy chain was detected with the anti-heavy chain AP conjugated antibody (Sigma #A3188) diluted 1:10,000 in TBST. The light chain was detected with the anti-kappa light chain AP conjugated antibody (Sigma #A3813). A slight improvement in heavy chain production was seen in transformant 206A (FIG. 6). The heavy chain was fragmented, but the full length and the 38 kD fragment were slightly improved over the parental stain. Additionally, total protease activity was measured with succinylated casein (QuantiCleave protease assay kit, Pierce #23263) according to the manufacturer's protocol. Transformant 206A/M455 showed the biggest decrease in protease activity compared to the parent strain M169 activity (FIG. 7). The total protease activity in the supernatant was reduced by 10% for M455.

Analysis of *Pichia*-Expressed Aspartic Proteases

Figure 8A:
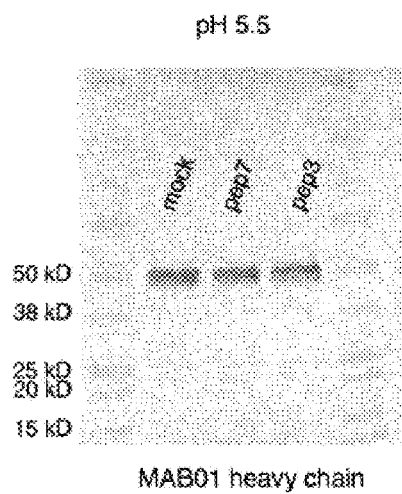
FIGS. 8A-C depict an immunoblot showing the effects of protease activity of PEP3 and PEP7 on MAB01 heavy chain and native IGF-1.
Figure 8B:
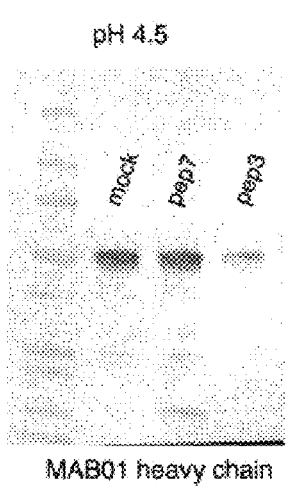
Figure 8C:
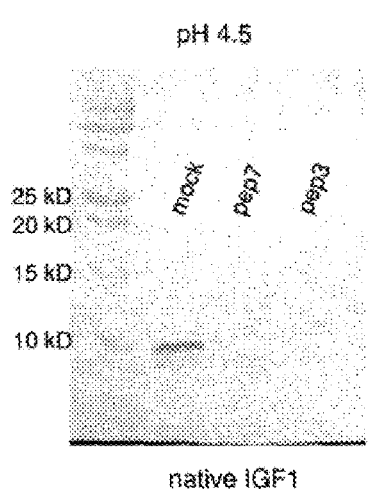

The *T. reesei* aspartic proteases pep3 (tre121133) and pep7 (tre58669) expressed from *Pichia* were also tested in vitro, by measuring the degradation of the MAB01 antibody and IGF-1. Degradation of MAB01 and IGF-1 by pep3 and pep7 was analyzed by immunoblotting. The aspartic proteases were produced in *Pichia* supernatants. *Pichia* supernatants were diluted to 1× concentration, and then mixed with 50 mM sodium citrate buffer, pH 5.5. MAB01 was added to each reaction so that the final concentration would be 0.05 μg μl. IGF-1 was added to each reaction so that the final concentration would be 0.30 μg μl. Ten microliters of each reaction mixture was then sampled and added to 3 μl of Laemmli sample buffer with β-mercaptoethanol. The samples were heated at 95° C. for 5 minutes before being loaded into a 4-15% PAGE gel (BioRad mini-protean TGX precast gel) along with an all blue precision plus prestained molecular weight marker (BioRad). The PAGE gel was run for 30 minutes at 200V. The proteins in the gel were then electrotransferred into a nitrocellulose filter at 100V for 1 hour. The protein containing nitrocellulose filter was then blocked with 5% milk powder in Tris buffered saline with 0.1% tween (TBST) for 1 hour shaking at room temperature. The blocked membranes were then probed with antibody. The MAB01 containing membranes were probed with an anti-IgG heavy chain antibody AP conjugate (Sigma #A3188) diluted 1:30,000 in TBST. The IGF-1 samples were analyzed using a primary anti-IGF-1 antibody (1:2000 in TBST) and anti-IgG AP conjugated secondary antibody (1:5000 in TBST). All antibody incubations were done for 1 hour at room temperature on a shaker. The membranes were then washed with 3 changes of TBST for 20 minutes each on the shaker. The membranes were developed with the BCIP/NBT alkaline phosphatase substrate (Promega #S3771) for up to 5 minutes. As shown in FIG. 8, the pep3 protease had low MAB01 degrading activity at pH 5.5 after overnight incubation at 37° C., but the activity was higher at pH 4.5. The pep7 protease only had minimal antibody degrading activity at pH 4.5.

Isolation of Additional Aspartic Proteases Using SIP Peptide

Several additional aspartic proteases were isolated from the *T. reesei* M277 triple protease deletion strain (pep1, tsp1, slp1). The M277 strain does not express heterologous proteins. The M277 deletion strain was generated as described in Example 4 below. The strain was grown in *Trichoderma* minimal medium supplemented with 20 g/l spent grain extract, 60 g/l lactose, and 9 g/l casamino acids at pH 5.5 and 28° C. The aspartic proteases were isolated by affinity purification using the SIP peptide (Ac-Phe-Lys-Phe-(AH-PPA)-Leu-Arg-$NH_2$) (Kataoka Y. et al. 2005 FEBS Letters 579, pp 2991-2994). The SIP peptide was conjugated to NHS activated agarose resin (Pierce #26196) using the protocol provided by the manufacturer. The SIP affinity resin was used to purify proteases. Fermentation supernatant (15 ml) from the *T. reesei* M277 strain was then used to batch bind proteases to the resin in 35 ml buffer containing 50 mM sodium acetate, 0.2 M NaCl, pH 3.0 (from fermentation conditions pH 5,5; 28° C.; 9 g/l casaminoacids; 20 g/L spent grain extract, 60 g/L lactose). The column was washed with the same binding buffer and bound protein removed with elution buffer (50 mM Tris-HCL, 1 M NaCl, pH 8.5). Fractions of 0.5 ml were then collected.

Figure 9:
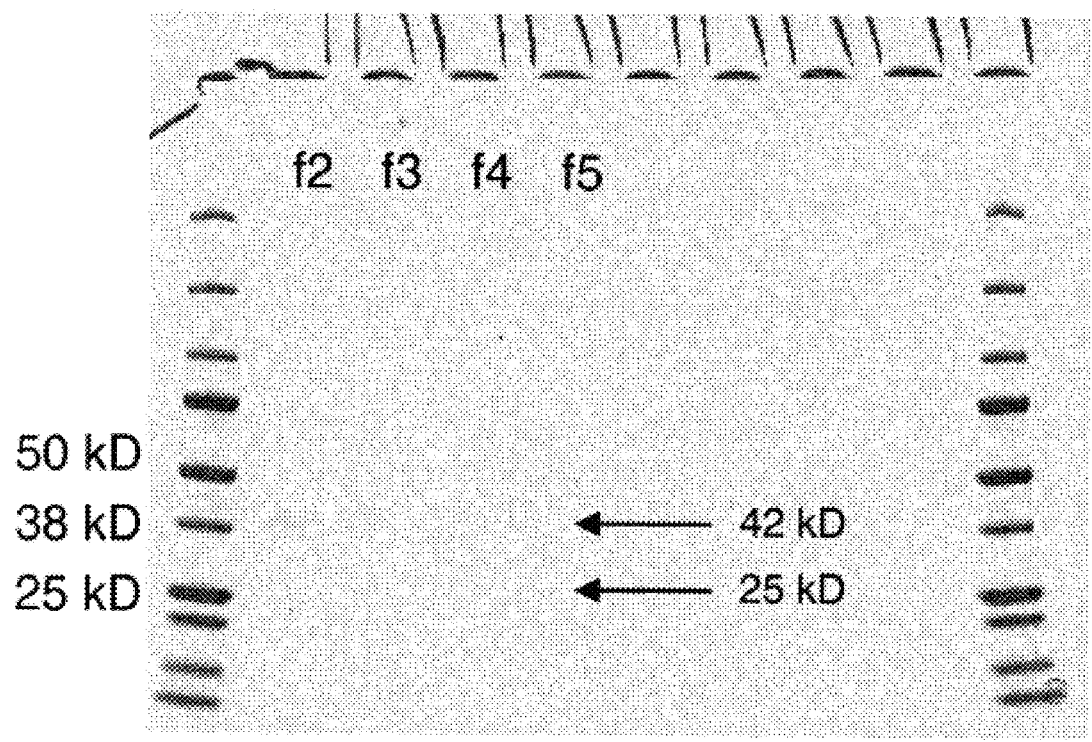
FIG. 9 depicts a PAGE gel showing protease containing fractions purified from SIP peptide affinity column.

30 µl of each purified fraction was then run on a 4-15% SDS PAGE gel (BioRad mini-protean TGX precast gel) and stained overnight with GelCode blue (Thermo Scientific). The SDS PAGE gel showed predominate bands around 42 kDa and a faint band around 25 kD (FIG. 9). The bands from the gel were then cut and subjected to in-gel trypsin digestion with sequencing grade modified trypsin (Promega #V5111). The resulting peptides were extracted from the gel and purified by C18 ZipTip (Millipore #ZTC18M096). The purified peptides were analyzed by LC-MS/MS on a QSTAR Pulsar, ESI-hybrid quadrupole-TOF (AB Sciex). This analysis revealed that PEP2, PEP3, PEP4, and PEP5 were present in the sample along with GAP1 and SLP2. It is believed that the faint band around 25 kD corresponds to the glutamic protease GAP1.

Figure 10:
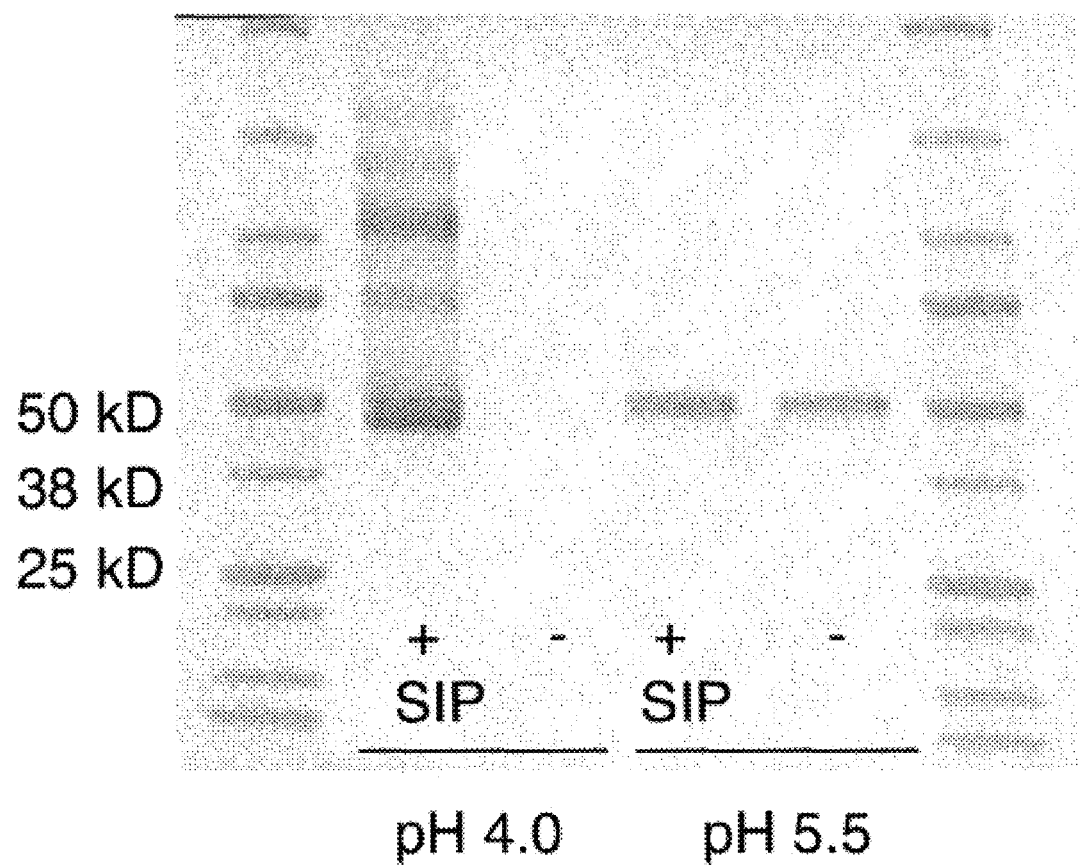
FIG. 10 depicts an immunoblot showing SIP protease activity on the MAB01 heavy chain.

The SIP purified proteases were then tested for their ability to degrade the MAB01 antibody heavy chain. The purified SIP proteases were incubated overnight with MAB01 at a final concentration of 0.05 µg µl in sodium citrate buffer at 37° C. The samples were incubated at pH 4.0 and pH 5.5 and both in the presence and absence of an SIP inhibitor peptide. The reactions were sampled after. The collected samples were analyzed by immunoblotting with an anti-IgG heavy chain antibody AP conjugate (Sigma A3188) diluted 1:30,000 in TBST. The results of the immunoblot showed that the proteases had high protease activity against the MAB01 heavy chain when incubated at pH 4.0, and reduced activity at pH 5.5 (FIG. 10). Additionally, both aspartic and glutamic protease activities were inhibited by incubation with the SIP peptide (FIG. 10).

Analysis of SIP-Purified Aspartic Proteases

Protease activity was then tested against casein both in the presence and absence of protease inhibitors. Protease activity against casein was tested using the EnzChek protease assay kit (Molecular probes #E6638, green fluorescent casein substrate). The working stock solution was prepared by diluting the stock to 10 µg ml in 50 mM sodium citrate, pH 5.5. The purified protease fractions (10 µl) were diluted with 40 µg/ml of sodium citrate, pH 5.5. 100 µl of the diluted substrate was combined with the diluted protease fractions in a 96 well sample plate. The plate was then covered and kept at 37° C. for one to three hours. Fluorescence readings were taken at one, two, and three hours with a Varioskan fluorescent plate reader (Thermo Scientific) using 485 nm excitation and 530 nm emission.

The SIP inhibitor peptide, pepstatin A, LIP peptide, SBTI, and chymostatin were used as inhibitors. The SIP inhibitor peptide inhibited both aspartic and glutamic proteases; pepstatin A inhibited only aspartic proteases; LIP peptide only inhibited glutamic protease; SBTI was able to inhibit SLP2 and PEP4, and chymostatin inhibited SLP2. SIP, LIP, and pepstatin A were used at a concentration of 60 µM, and SBTI was used at a concentration of 200 µg/ml. To differentiate between the aspartic and glutamic proteases, pepstatin A was used as inhibitors, as it does not inhibit glutamic proteases.

Figure 11:
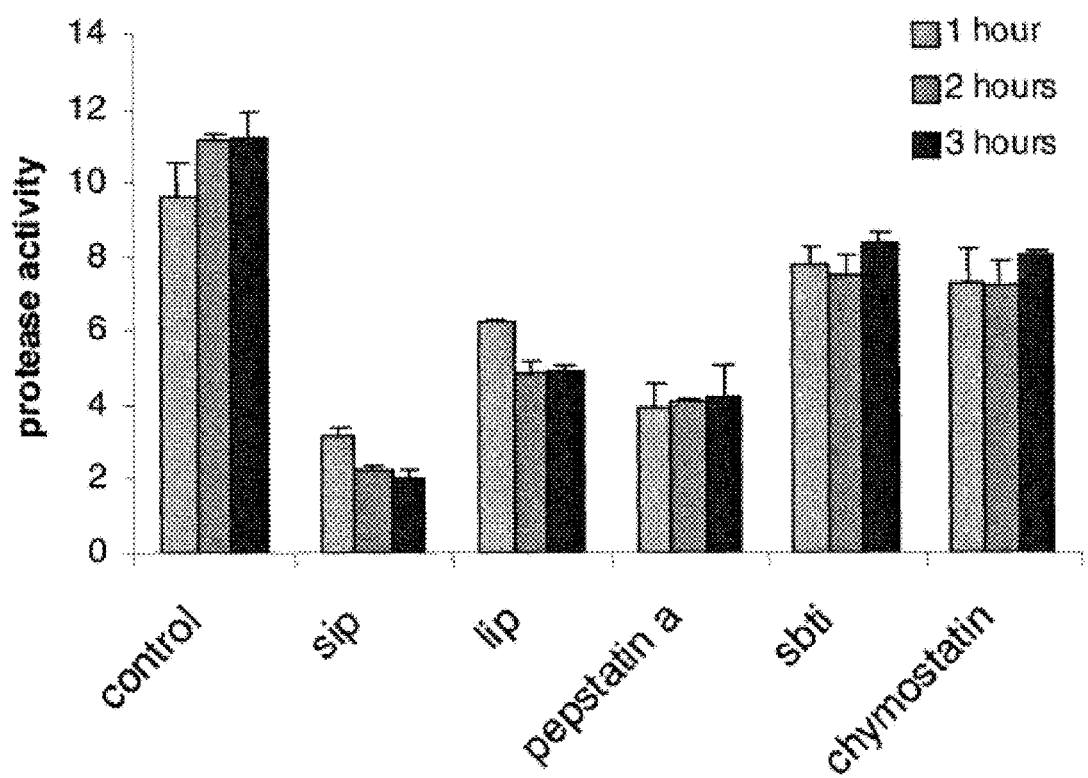
FIG. 11 graphically depicts protease activity against casein with and without inhibitors.

When casein digestion was studied, a large portion of the SIP protease activity was inhibited by pepstatin A (FIG. 11). The results from casein degradation studies suggested that a large part of the activity at pH 5.5 in the purified fractions comes from aspartic proteases. The LIP peptide, which is the GAP1 propeptide, inhibited the protease activity slightly less compared to SIP inhibitor. The SBTI and chymostatin were able to inhibit the SLP2 protease in the purified sample.

These results support the conclusion that there are 4 aspartic proteases present in the SIP fraction (PEP2, PEP3, PEP4, and PEP5).

Example 2—Identification of Glutamic Proteases

This example demonstrates the ability of glutamic proteases from *Trichoderma reesei* (*T. reesei*) culture supernatants to degrade antibody heavy chains and light chains.

Analysis of Gap1 Deletion

It has been previously determined that there are four glutamic protease sequences in the *T. reesei* genome. The most abundant glutamic protease is gap1 (tre69555), as determined by transcriptional profiling. Accordingly, the gap1 protease was purified from *T. reesei* supernatant from SIP peptide affinity chromatography, as described Example 1.

A gap1 deletion was then generated using the *T. reesei* MAB 01 antibody production strain M244 (Δpep1).

Generation of Gap1 Deletion Plasmid

The deletion pTTv1 17plasmid for the glutamic protease gap1 (TreID69555) was constructed essentially as described for pep1 deletion plasmid pTTv41 in Example 1. 1000 bp of 5' flanking region and 1100 bp of 3' flanking region were selected as the basis of the gap1 deletion plasmid. Flanking region fragments were produced by PCR using the primers listed in Table 2.1. The products were separated with agarose gel electrophoresis and the correct fragments were isolated from the gel with gel extraction kit (Qiagen) using standard laboratory methods. Template DNA used in the PCR of the flanking regions was from the *T. reesei* wild type strain QM6a. The pyr4 blaster cassette was obtained from pTTv71 with NotI digestion. The vector backbone was EcoRI/XhoI digested pRS426 as in Example 1. The plasmid was constructed using the yeast homologous recombination method described in Example 1. This deletion plasmid for gap1

(pTTv117) resulted in a 1037 bp deletion in the gap1 locus and covers the complete coding sequence of Gap1.

TABLE 2.1

Primers for generating gap1 deletion plasmid. Deletion plasmid pTTvI17 tor gap1 (TreID69555), vector backbone pRS426

| Primer | Sequence |
| --- | --- |
| JJ-045 primer | GATTAAGTTGGGTAACGCCAGGGTTTTCCCAGT CACGACGGTTTAAACACCTCATGAGGGACTATG G (SEQ ID NO: 271) |
| JJ-046 primer | GCGCTGGCAACGAGAGCAGAGCAGCAGTAGTCGA TGCTAGGCGGCCGCCAAGAAGAGGCAGAGGGTAA T (SEQ ID NO: 272) |
| JJ-047 primer | CAACCAGCCGCAGCCTCAGCCTCTCTCAGCCTCA TCAGCCGCGGCCGCCTATACATACTGATGATACA (SEQ ID NO: 273) |
| JJ-048 primer | TGGAATTGTGAGCGGATAACAATTTCACACAGGA AACAGCGTTTAAACGCCCCATGTATGGACTCTAC (SEQ ID NO: 274) |

Generation of MAB01 Producing Δpep1/Δgap1 Double Deletion Strain M296

To generate the MAB01 antibody producing strain for the second protease deletions, the pep1 deletion strain M181 (Example 1) was transformed with MAB01 light and heavy chain constructs (pTTv98+pTTv67) using hygromycin and acetamide in selection. This MAB01 strain with the pep1 deletion was designated with number M244. The removal of the pyr4 blaster cassette from pep1 locus was carried out essentially as described in Example 3 below for M195 (in generation of double protease deletion strain M219). This pyr4⁻ strain was designated with number M285 and used as the parent for the subsequent protease deletion.

To remove vector sequence, plasmid pTTv1 17 (Δgap1-pyr4) was digested with PmeI and the correct fragment purified from an agarose gel using QIAquick Gel Extraction Kit (Qiagen). Approximately 5 μg of the gap1 deletion cassette was used to transform strain M285 (pyr4⁻ of MAB01 antibody strain M244, based on Δpep1 strain M181). Preparation of protoplasts and transformation were carried out using pyr4 selection essentially as described for the pep1 deletion strains M181 and M195 in Example 1.

Colonies from the transformation plates were picked as selective streaks. Clones growing fast as selective streaks were screened by PCR using the primers listed in Table 2.2 for the correct integration using standard laboratory methods. Putative disruptants were purified to single cell clones.

TABLE 2.2

Primers for screening gap1 integration and strain purity.

| Primer | Sequence |
| --- | --- |
| For screening integration of pTTvI17 | |
| T052_gap1_5screen_F | CTCAGAAAGGTTGTAGTTGTGA (SEQ ID NO: 275) |
| T026_Pyr4_orf_5rev2 | CCATGAGCTTGAACAGGTAA (SEQ ID NO: 276) |
| T053_gap1_3screen_R | GATGTTGTGTTTTCAGTCTGCA (SEQ ID NO: 277) |
| T028_Pyr4_flank_rev | CATCCTCAAGGCCTCAGAC (SEQ ID NO: 278) |

TABLE 2.2-continued

Primers for screening gap1 integration and strain purity.

| Primer | Sequence |
| --- | --- |
| For screening deletion of gap/ ORF | |
| T109_gap1_ORF_F | ATGTTCATCGCTGGCGTCG (SEQ ID NO: 279) |
| T110_gap1_ORF_R | CTAAACGTAAGAGCAGGTCAA (SEQ ID NO: 280) |

Analysis of MAB01 Producing Δpep1 Δgap1 Double Deletion Strain

Figure 12A:
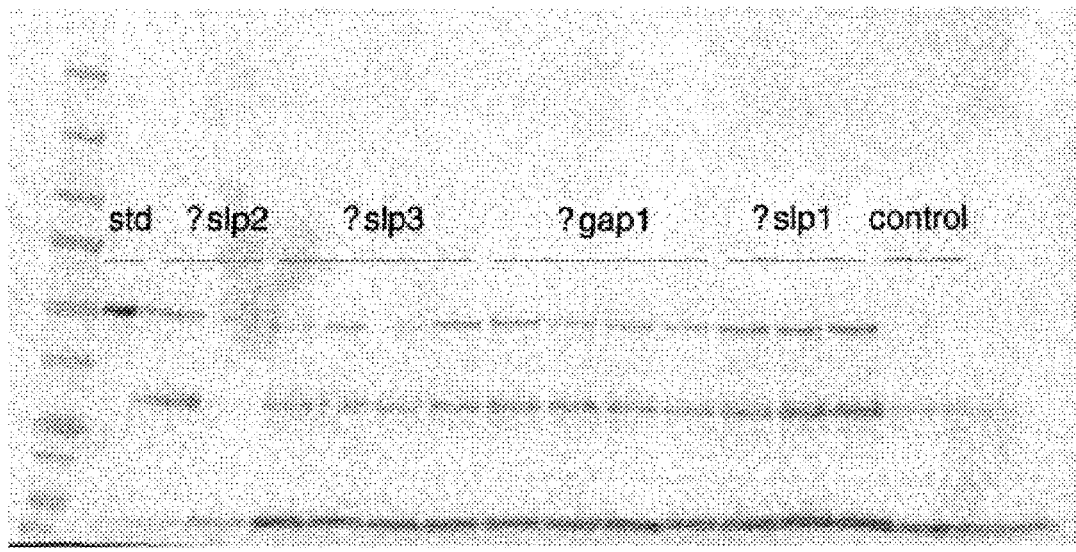
FIGS. 12A-B depict an immunoblot showing the levels of MAB01 heavy and light chain production after deletion of each of slp1, slp2, slp3, and gap1 proteases.
Figure 12B:
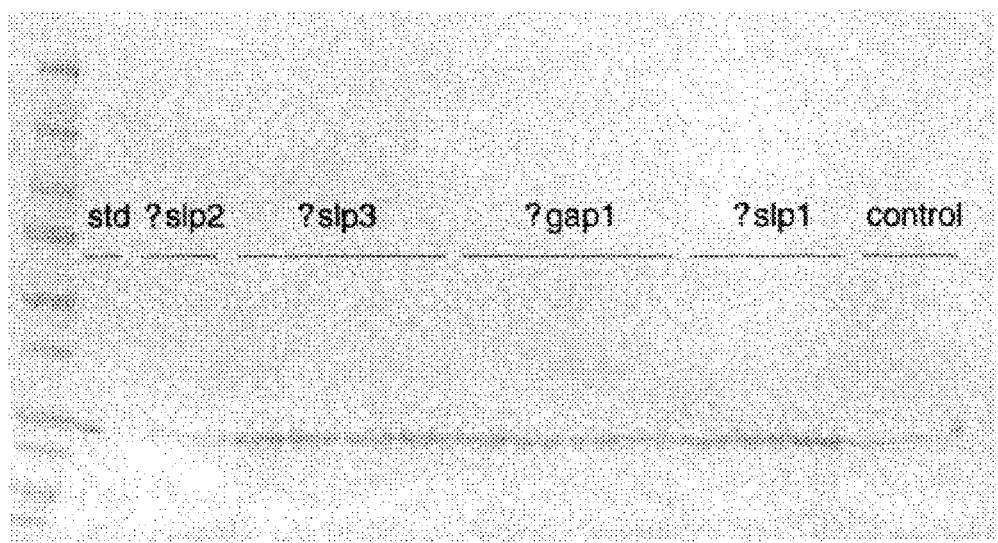
Figure 13:
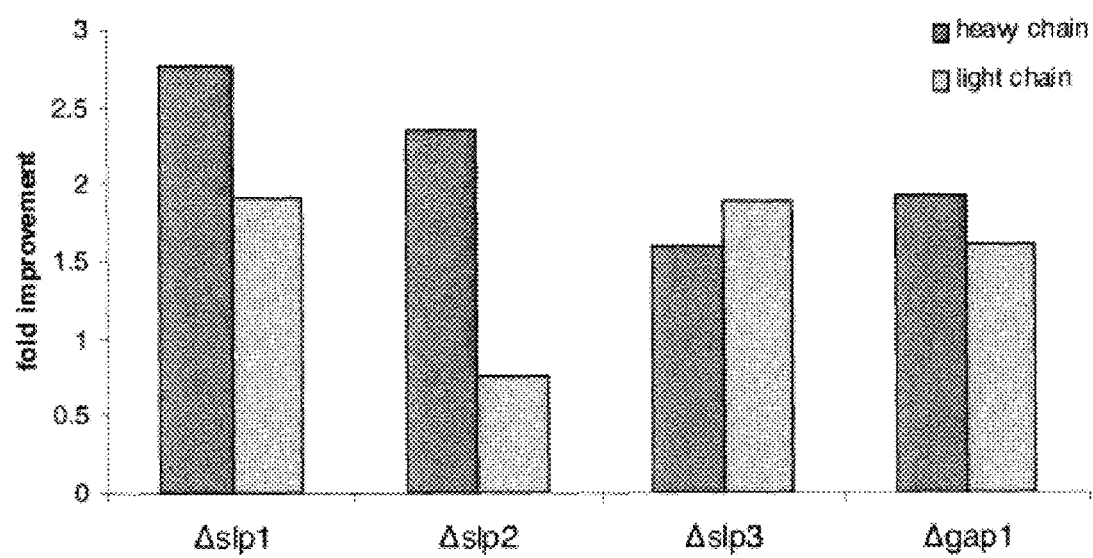
FIG. 13 graphically depicts the fold improvement in MAB01 heavy and light chain production after deletion of each of slp1, slp2, slp3, and gap1 proteases. Each bar represents the average from several of the clones shown in FIG. 12.

The double deletion strain (Δpep1 Δgap1) was grown in a 2 liter shake flask culture containing 300 ml of Trichoderma minimal medium supplemented with 40 g/l lactose, 20 g/l spent grain extract, and 9 g/l casamino acids and buffered to pH 5.5 with 100 mM PIPPS. The Δgap1 strain was then tested for MAB01 heavy chain and light chain production (FIG. 12). The Δgap1 strain was compared to strains having deletions in each of slp1, slp2, and slp3. The Δpep1 strain M244 was used as a control. Samples were from day 7 large shake flask cultures. Samples were analyzed via immunoblotting with anti-IgG heavy chain (Sigma #A3188) or anti-light chain (Sigma #A3812) antibody AP conjugate (FIG. 12). The gap1 deletion resulted in a 2-fold improvement in heavy chain production and a 1.6-fold improvement in light chain production as compared to the M244 control strain (FIG. 13).

Analysis of Gap2 Deletion

Based upon transcriptional profiling data generated from the M194 Trichoderma reesei strain, the second most abundant glutamic protease was identified as gap2 (tre106661). Thus, the gap2 protease was also deleted from the M244 (Δpep1) strain using the pTTV145 deletion construct.

Generation of Gap2 Deletion Plasmid

The pTTv145deletion plasmid for the glutamic protease gap2 (TreID106661) was constructed essentially as described for pep1 deletion plasmid pTTv41 in Example 1. 1021 bp of 5' flanking region and 1010 bp of 3' flanking region were selected as the basis of the gap2 deletion plasmid. In this plasmid the direct repeat fragment of the pyr4 blaster cassette was changed from pyr4 5'UTR to 320 bp direct repeat from the end of gap2 5' flanking region and no AscI site was added between the pyr4 and the 5' direct repeat. This type of blaster cassette should not leave any additional sequence to the locus of the deleted gene after excision. Fragments were produced by PCR using the primers listed in Table 2.3. The products were separated with agarose gel electrophoresis and the correct fragments were isolated from the gel with gel extraction kit (Qiagen) using standard laboratory methods. Template DNA used in the PCR of the flanking regions was the T. reesei wild type strain QM6a. The pyr4 marker gene was obtained from pHH05 with NotI digestion. The vector backbone was EcoRI/XhoI digested pRS426 as in Example 1. The plasmid was constructed using the yeast homologous recombination method described in Example 1. This deletion plasmid for gap2 (pTTv145) results in a 944 bp deletion in the gap2 locus and covers the complete coding sequence of GAP2.

TABLE 2.3

Primers for generating gap2 deletion plasmid.
Deletion plasmid pTTv145 for gap2 (TreID106661),
vector backbone pRS426

| Primer | Sequence |
|---|---|
| T101_gap2_5flank_F_pRS426 | GATTAAGTTGGGTAACGCCAGGGTTTTCCC AGTCACGACGGTTTAAACGCTACTACGCGA GCAAGTG (SEQ ID NO: 281) |
| T102_gap2_5flank_R_pyr4 | GGAACTGTCGGCGATTGGGAGAATTTCGTG CGATCGCGGCGGCCGCCGGATGAAGATGTG CAGTTG (SEQ ID NO: 282) |
| T103gap2-loop_F_pyr4 | AGGGAACATATCACCCTCGGGCATTTTTCA TTTGGTAGGCGGCCGCTAAGATATCTTCAA GCTTATGCG (SEQ ID NO: 283) |
| T104gap2-loop_R | CGGATGAAGATGTGCAGTTG (SEQ ID NO: 284) |
| T105gap2_3flank_F_loop | TGTCTCACTTCCACCCATCTCAACTGCACAT CTTCATCCGAGCAACAACATGAGGTTCGAA (SEQ ID NO: 285) |
| T106_gap2_3ilank_R_pRS426 | CCTATGTTGTGTGGAATTGTGAGCGGATAAC AATTTCACAGTTTAAACAACAACGCATGTCCA GCTTTTG (SEQ ID NO: 286) |

Generation of MAB01 Producing Δpep1/Δgap2 Double Deletion Strains M360

To generate the MAB01 antibody producing strain for the second protease deletions, the pep1 deletion strain M181 (Example 1) was transformed with MAB01 light and heavy chain constructs (pTTv98+pTTv67) using hygromycin and acetamide in selection. The removal of the pyr4 blaster cassette from pep1 locus was carried out essentially as described in Example 3 below for M195 (in generation of double protease deletion strain M219). This pyr4⁻ strain was designated with number M285 and used as the parent for the subsequent protease deletion.

To remove vector sequence, plasmid pTTv145 (Δgap2-pyr4) was digested with PmeI and the correct fragment purified from an agarose gel using QIAquick Gel Extraction Kit (Qiagen). Approximately 5 µg of the gap2 deletion cassette was used to transform strain M285 (pyr4⁻ of MAB01 antibody strain M244, based on Δpep1 strain M181). Preparation of protoplasts and transformation were carried out using pyr4 selection essentially as described for the strains M181 and M195 in Example 1.

Colonies from the transformation plates were picked as selective streaks. Clones growing fast as selective streaks were screened by PCR using the primers listed in Table 2.4 for the correct integration using standard laboratory methods. Putative disruptants were purified to single cell clones.

TABLE 2.4

Primers for screening gap2 integration and strain purity.

| Primer | Sequence |
|---|---|
| *For screening integration of pTTv145* | |
| T048_gap2_5screen_F | GCTTGGCATCACGGAAGCT (SEQ ID NO: 287) |
| T026_Pyr4_orf_5rev2 | CCATGAGCTTGAACAGGTAA (SEQ ID NO: 288) |
| T049_gap2_3 screen_R | TTGACAAGAAAGGTCCGGTTG (SEQ ID NO: 289) |

TABLE 2.4-continued

Primers for screening gap2 integration and strain purity.

| Primer | Sequence |
|---|---|
| T028_Pyr4_ilank_rev | CATCCTCAAGGCCTCAGAC (SEQ ID NO: 290) |
| *For screening deletion otgap2 ORF* | |
| T107 gap2 ORF F | ATGGATGCTATCCGAGCCAG (SEQ ID NO: 291) |
| T108 gap2 ORF R | CTATTCATACTCAACAGTCACA (SEQ ID NO: 292) |

Analysis of MAB01 Producing Δpep1 Δgap2 Double Deletion Strain

Figure 14A:
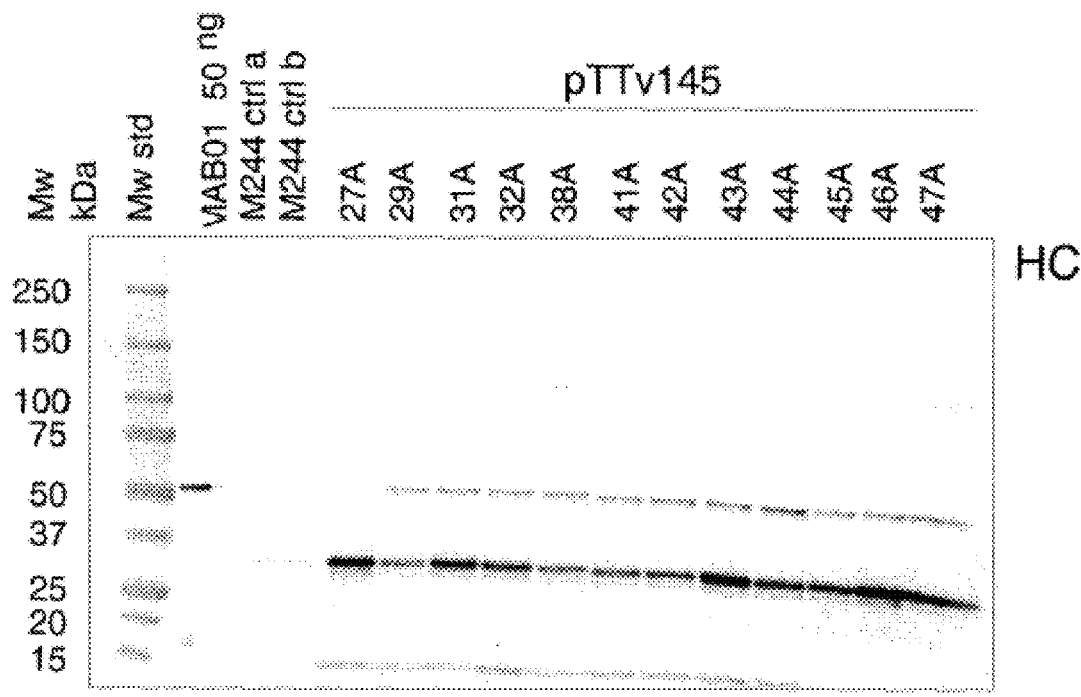
FIGS. 14A-B depicts an immunoblot showing the levels of MAB01 production from the gap2 deletion strain M244.
Figure 14B:

Several deletion transformants were produced. The culture supernatants from these transformants were run on a 4-15% SDS PAGE gel and then the MAB01 antibody heavy chain was analyzed by immunoblotting with an anti-heavy chain AP conjugated antibody (Sigma #A3188), and the light chain was detected with an anti-light chain AP conjugated antibody (Sigma #A3812). The results of the immunoblot show that deleting gap2 resulted in a several fold increase in MAB01 heavy and light chain production (FIG. 14).

Analysis of *Pichia*-Expressed Gap2

Figure 15:
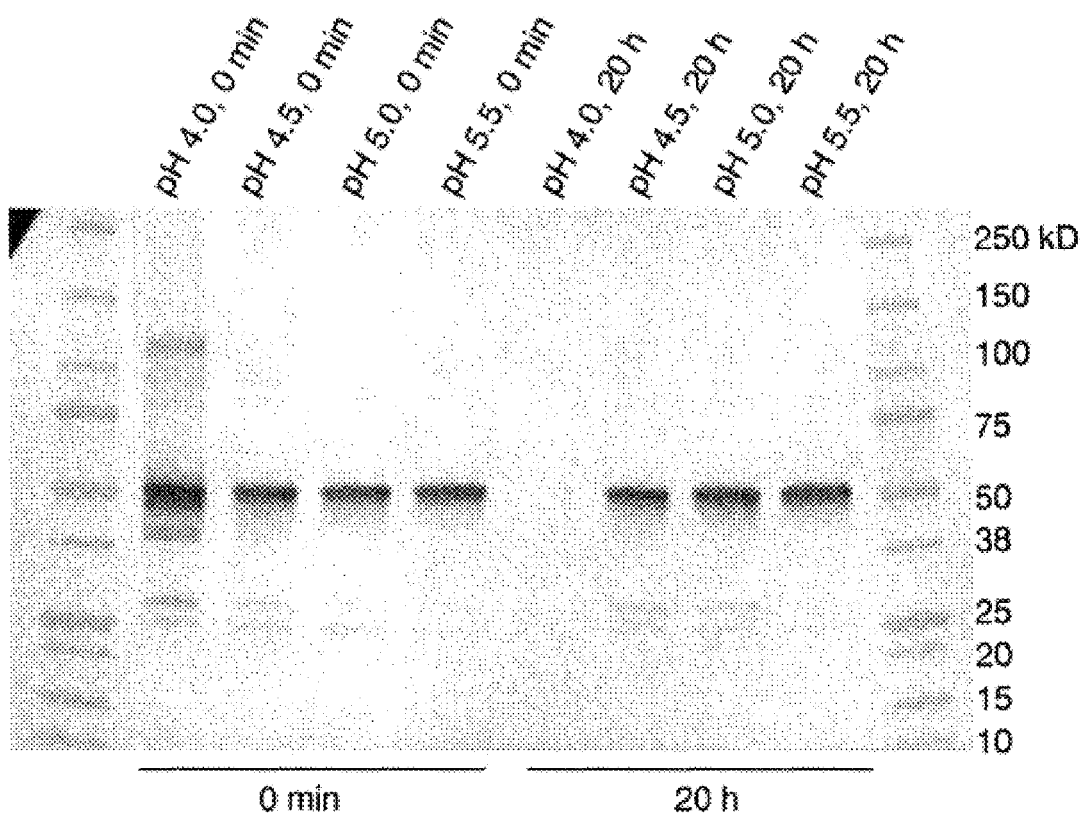
FIG. 15 depicts an immunoblot showing the levels of MAB01 antibody after incubation with *Pichia* supernatant containing the GAP2 protease.

*Pichia* supernatants containing *Trichoderma reesei* gap2 were also studied in vitro. The gap2 containing supernatant and MAB01 antibody were diluted into sodium citrate buffers adjusted to pH 4.0, 4.5, 5.0, and 5.5, and incubated for 20 hours at 37° C. Samples were taken at 0 minutes and after 20 hours. MAB01 heavy chain production was analyzed by immunblotting using an anti-IgG heavy chain (Sigma #A3188) antibody AP conjugate. The results of the immunoblot show that gap2 had maximal proteolytic activity against heavy chain MAB01 at pH 4.0 (FIG. 15). While the gap2 protease activity was low at pH 5.5 (FIG. 15), over 4 days it was able to demonstrate significant activity on the heavy chain. The gap2 protease produced degradation products around 25 kD, indicating that it has proteolytic activity in the heavy chain hinge region.

Example 3—Identification of Serine Proteases

This example demonstrates the ability of serine proteases from *Trichoderma reesei* (*T. reesei*) to degrade antibody heavy chains and light chains.

Serine Protease Purification

Serine proteases comprise a major family of proteases that have been identified as antibody degrading enzymes. Accordingly, serine proteases were purified from *Trichoderma* supernatant. The serine proteases were first affinity purified from fermentation culture supernatants with a p-aminobenzamidine sepharose 4 fast flow resin (GE healthcare #17-5123-10). 15 ml of the fermentation culture supernatant was batch bound to the resin in 35 ml of binding buffer (0.05 M Tris-HCL, 0.5 M NaCl, pH 7.4). After packing and washing the column with the same binding buffer, the column was eluted with 0.05 M glycine, pH 3.0. The fractions were then neutralized with 1M Tris HCL, pH 8.8.

Figure 16:
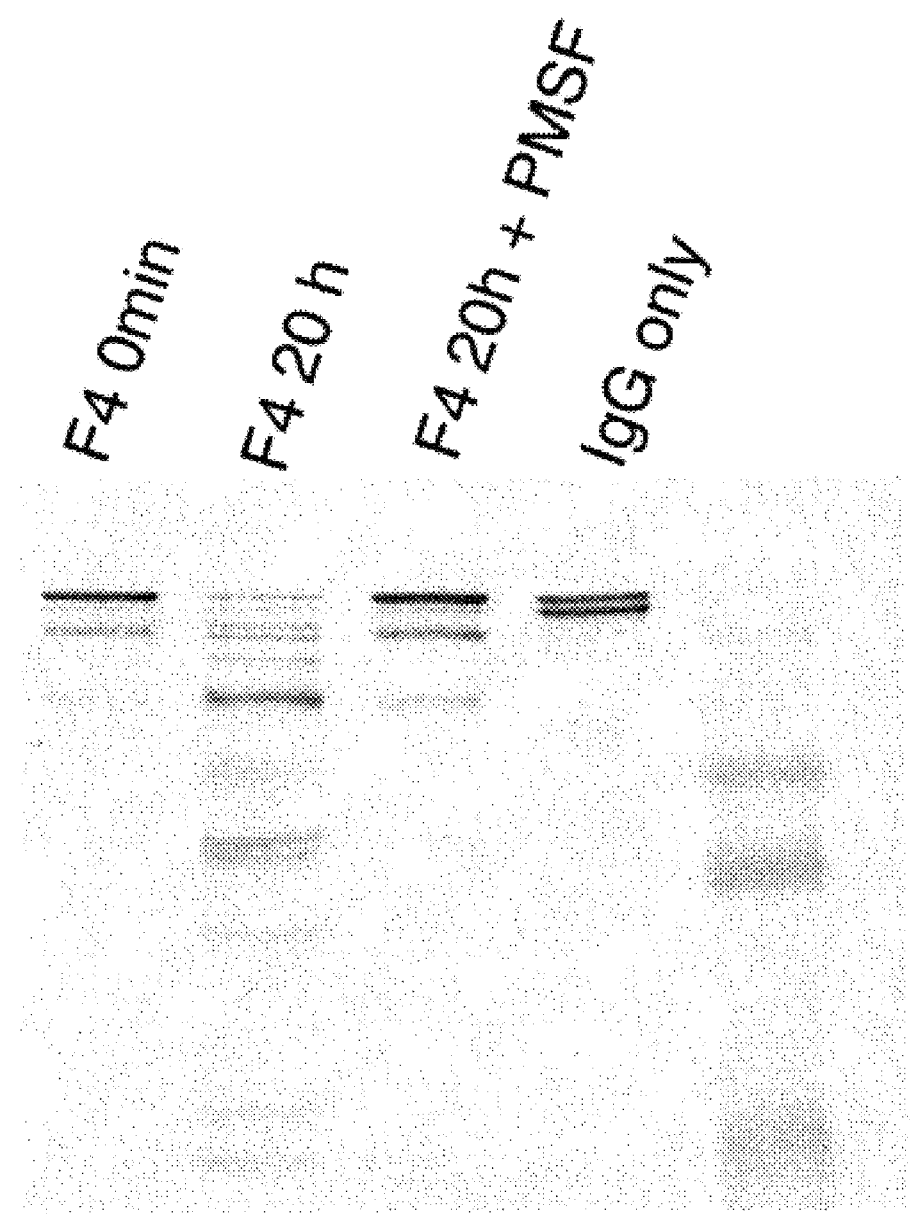
FIG. 16 depicts an immunoblot showing the level of protease degradation of human IgG1.

In total 1.7 mg of protein was purified from the affinity column. When the peak fractions were run on a 4-15% SDS-PAGE gel, several major bands (~110 kD, 53 kD, 39 kD, 29 kD) and many more minor bands were seen. The peak fraction protein mixture (F4) was then tested for protease activity by incubated a sample of the F4 with human IgG1 in sodium citrate buffer (50 mM, pH 5.5) at 37° C. for 20 hours. The samples were incubated both in the presence and absence of the serine protease inhibitor PMSF (5 mM). The incubated samples were then analyzed by immunoblotting with an anti-IgG heavy chain AP conjugate antibody (Sigma #A3188) and an anti-IgG light chain AP conjugate antibody (Sigma #A3812) diluted 1:30,000 in TBST. The results of the immunoblot showed that the F4 purified protein fraction thoroughly degraded the IgG (FIG. 16). Additionally, treatment with PMSF was able to inhibit most of the degradation, indicating that the protease activity in the F4 fraction that was responsible for the IgG degradation was predominantly serine protease activity.

Figure 17:
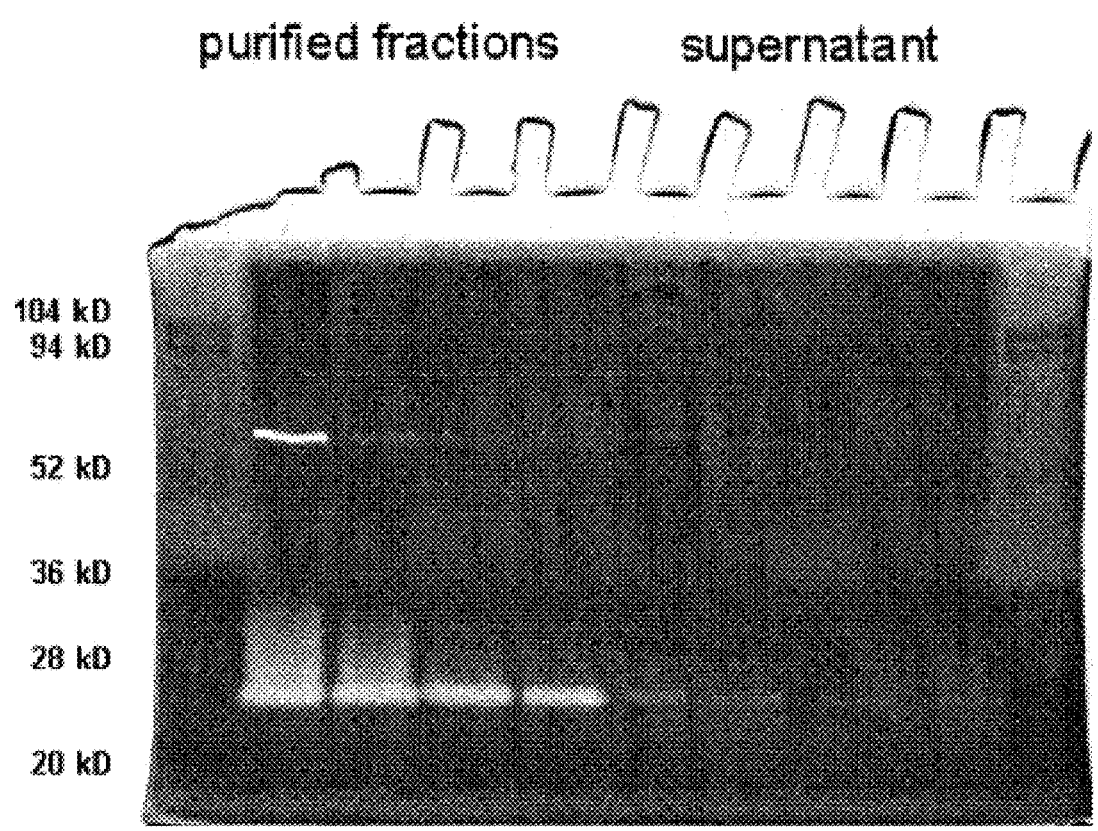
FIG. 17 depicts the results of an MAB02 antibody zymogram from affinity purification with an aminobenzamidine column (purified fractions), and from supernatant samples (supernatant).

In order to identify which proteins in the purified fractions exhibited protease activity, the peak fractions were run on an IgG (0.5 mg/ml MAB02) SDS PAGE zymogram gel (12%). The purified fractions and unpurified supernatant samples were run on the zymogram gel under denaturing conditions. After running the gel, the proteins in the gel were renatured by incubating the gel in 1% triton X-100 to remove the SDS. The zymogram gel was then allowed to incubate overnight in reaction buffer (50 mM sodium citrate, pH 5.5) so that the proteases could degrade IgG in the gel. The gel was then stained with GelCode blue to reveal the extent of IgG staining. Active proteases produced a clear band with no staining (FIG. 17).

There were two clear bands visible on the IgG gel zymogram at around 29 kD and 65 kD. However, the band at 29 kD was much more predominant suggesting it may be responsible for most of the serine protease activity in the sample. These bands were the only two visible ones in the unpurified supernatant sample, and were more pronounced in the purified fractions (FIG. 17). When the protease sample was pre-treated with PMSF, a known serine protease inhibitor, the clear white bands appeared grey or were not visible, indicating that the bands correspond to serine protease enzymes (FIG. 17).

Identification of the 29 kD Serine Protease TSP1

From a matched SDS PAGE gel without MAB02, the 29 kD band was cut from the gel and subjected to in-gel trypsin digestion with sequencing grade modified trypsin (Promega #V5111). In the purified fractions, the 29 kD band was seen as a distinct protein band. This distinct band was then isolated. The resulting peptides were extracted from the gel and purified by CI 8 ZipTip (Millipore #ZTC18M096). The purified peptides were analyzed by LC-MS/MS on a QSTAR Pulsar, ESI-hybrid quadrupole-TOF (AB Sciex). The resulting mass analysis clearly identified the 29 kD band as the trypsin-like serine protease TSP1 (tre73897, 35% sequence coverage).

Analysis of Tsp1 Deletion

Figure 40:
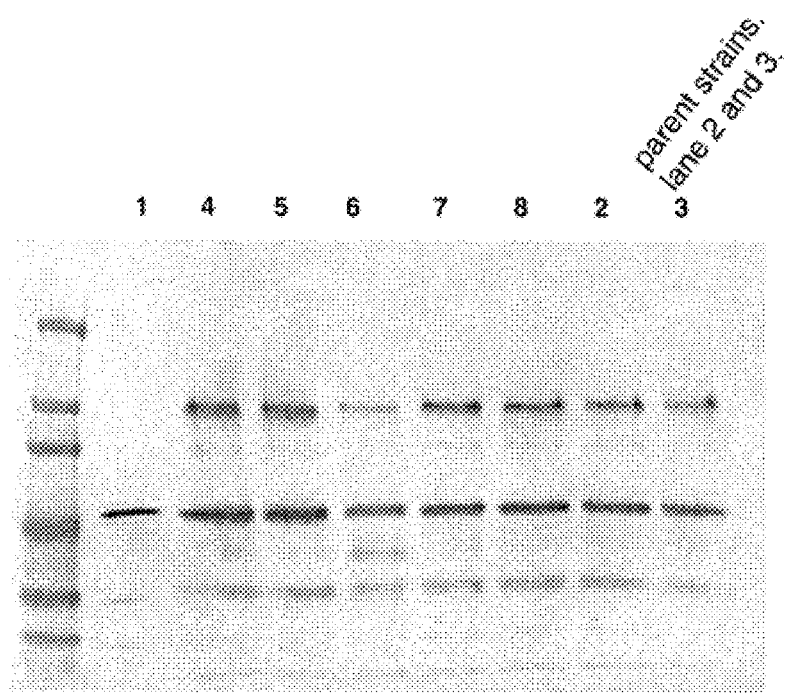
FIG. 40 depicts an immunoblot showing improved production of the rituximab (Rx) heavy chain from *T. reesei* cells containing a deletion of the tsp1 protease. Transformants 12-2 A and 12-16A clearly show more heavy chain compared to the parent strain.

The gene encoding TSP1 (tsp1) was then deleted from the rituximab antibody production strain M169 to create M183 (Δtsp1). Shake flask cultures were made with M169 and the tsp1 deletion strain transformants to measure the effect on rituximab expression. The cultures were grown in 300 ml of TrMM with 4 g/L lactose, 2 g/L spent grain extract, and 100 mM PIPPS, pH 5.5. Supernatant samples (30 µl) from day 5 were loaded into a 4-15% SDS PAGE gel and transferred to nitrocellulose for immunoblotting with an anti-heavy chain AP conjugated antibody (Sigma #A3188) diluted 1: 10,000 in TBST. Two tsp1 deletion strain transformants showed a clear increase in rituximab heavy chain expression compared to the parent control strain (FIG. 40).

The deletion construct for the first protease gene, pep1 (TreID74156), was designed as described above in Example 1.

Generation of Tsp1 Deletion Plasmids

The deletion plasmids for the alkaline trypsin-like serine protease tsp1 (TreID71322/TreID73897, Dienes et al, 2007, Enz Microb Tech 40: 1087-1094) were constructed essentially as described for the pep1 deletion plasmids in Example 1. 953 bp of 5' flanking region and 926 bp of 3' flanking region were selected as the basis of the tsp1 deletion plasmids. As for pep1, the first deletion plasmid for tsp1 (pTTv42) used bar as the selection marker. The flanking region fragments were produced by PCR using the primers listed in Table 3.1. The products were separated with agarose gel electrophoresis and the correct fragments were isolated from the gel with gel extraction kit (Qiagen) using standard laboratory methods. Template DNA used in the PCR of the flanking regions was from the *T. reesei* wild type strain QM6a. The bar marker was obtained from pTTv41 (Example 1) with NotI digestion. The vector backbone was EcoRVXhoI digested pRS426 as in Example 1. The plasmid was constructed using the yeast homologous recombination method described in Example 1.

To clone the second tsp1 deletion plasmid (pTTv72), the bar marker was removed from the deletion plasmid pTTv42 with NoiI digestion. The pyr4 blaster cassette was obtained from pTTv71 (Example 1) with NotI digestion, ligated to NotI cut pTTv42 and transformed into *E. coli* using standard laboratory methods. A few transformants were cultivated, plasmid DNA isolated and digested to screen for correct ligation and orientation of the pyr4 blaster cassette using standard methods. One clone with correct insert size and orientation was sequenced and stored. These deletion plasmids for tsp1 (pTTv42 and pTTv72) result in a 1252 bp deletion in the tsp1 locus and cover the complete coding sequence of TSP1.

TABLE 3.1

Primers for generating tsp1 deletion plasmids.

| Primer | Sequence |
|---|---|
| Deletion plasmid pTTv42 for tsp1 (TreID71322/TreID73897), vector backbone pRS426 | |
| T303_71322_5f | GTAACGCCAGGGTTTTCCCAGTCACGACGGTTT AAACTGCTGTTGCTGTTTGTTGATG (SEQ ID NO: 293) |
| T304_71322_5r_pt | CCCGTCACCGAGATCTGATCCGTCACCGGGATC CACTTAAGCGGCCGCCTGTGGTGAGATCTCCAG ACG (SEQ ID NO: 294) |
| T305_71322_3f_pt | GCCAAGCCCAAAAAGTGCTCCTTCAATATCATC TTCTGTCGCGGCCGCACTGTGCCCAACAATAAG CAG (SEQ ID NO: 295) |
| T306_71322_3r | GCGGATAACAATTTCACACAGGAAACAGCGTTT AAACCCAAGGCGCTGGCTGTTA (SEQ ID NO: 296) |
| Deletion plasmid pTTv72 for tsp1 (TreID71322/TreID73897), vector backbone pTTv42 | |
| no new primers, pTTv42 digested with NotI and ligated with pyr4-loopout fragment from pTTv71 | |

Generation of Pep1tsp1 Double Deletion Strain M219

To reuse pyr4 as the selection marker, removal of the pyr4 blaster cassette from the pep1 deletion strain M195 was carried out. Spores were spread onto minimal medium plates containing 20 g/l glucose, 2 g/l proteose peptone, 1 ml/l Triton X-100, 5 mM uridine and 1.5 g/l 5-FOA, pH 4.8. 5-FOA resistant colonies were picked after 5-7 days to 0.9% NaCl, suspended thoroughly by vortexing and filtrated through a cotton-filled pipette tip. To purify clones to single cell clones, filtrates were spread again onto plates described above. Purified clones were sporulated on plates containing 39 g/l potato dextrose agarose. These clones were tested for uridine auxotrophy by plating spores onto minimal medium plates (20 g/l glucose, 1 ml/1 Triton X-100) where no growth was observed, indicating that the selected clones were pyr4⁻. All clones were further tested by PCR (using the primers listed in Table 3.2) for the removal of the blaster cassette and were shown to be correct. The clone (9-35A-1A-a) used to generate the double protease deletion strain (M219) was designated with strain number M196 (Δpep1, pyr4⁻).

To remove vector sequence, plasmid pTTv72 (Δtsp1-pyr4) was digested with PmeI and the correct fragment was purified from an agarose gel using a QIAquick Gel Extraction Kit (Qiagen). Approximately 5 µg of the tsp1 deletion cassette was used to transform M196 (Δpep1, pyr4⁻). Preparation of protoplasts and transformation were carried out using pyr4 selection essentially as described for the pep1 deletion strains M181 and M195 in Example 1.

Figure 18A:
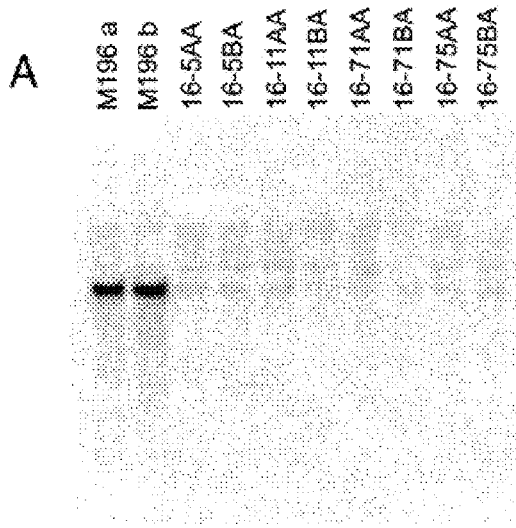
FIGS. 18A-C depict the generation of the Δpep1 Δtsp1 double protease deletion strain M219. M219=16-5AA. M196a, M196b=pyr4– of M195.
Figure 18B:
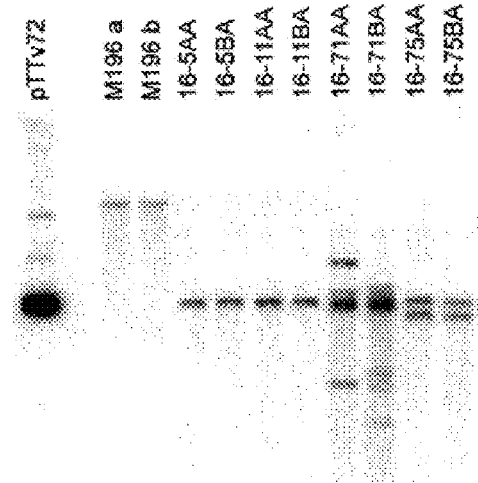
Figure 18C:
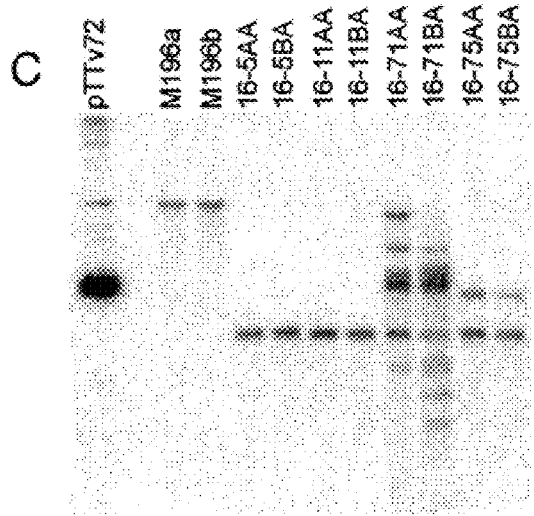

Over 100 colonies were picked and 48 were screened by PCR using the primers listed in Table 3.2 for the correct integration of the deletion cassette and also for the deletion of the tsp1 ORF using standard laboratory methods. Four putative Δtsp1 clones were purified to single cell clones. Deletion of tsp1 was verified by Southern analyses from these clones (FIG. 18A) using standard laboratory methods described in Example 1 for M181 and M195. Southern analyses also indicated that only four transformants (two parallel clones from two transformants, clones 16-5AA, 16-5BA, 16-11AA, 16-11BA, FIGS. 18B and 18C) were single integrants. The other clones were determined to carry additional copies somewhere else in the genome and were discarded. To exclude that the faint signal seen in FIG. 18 for the tsp1 ORF in transformants would originate from tsp1 gene, the deletion of tsp1 ORF was confirmed by PCR using the primers in Table 3.2. No signal for tsp1 ORF was obtained. The clone (16-5AA) used in removal of the pyr4 blaster cassette (and to generate the triple deletion strain M277) was designated with strain number M219 (Δpep1Δtsp1).

Generation of MAB01 producing Δpep1Δtsp1 double deletion strains M252

To remove vector sequence, plasmid pTTv42 (Δtsp1-bar) was digested with PmeI and the correct fragment purified from agarose gel using QIAquick Gel Extraction Kit (Qiagen). Approximately 5 µg of the tsp1 deletion cassette was used to transform strain M181 (Δpep1, Example 1). Preparation of protoplasts and transformation were carried out using bar selection essentially as described for the pep1 deletion strain M182 in Example 1.

Figure 19A:
FIGS. 19A-C depict Southern blot analysis showing the generation of the Δpep1Δtsp2 double deletion strain M194.
Figure 19B:
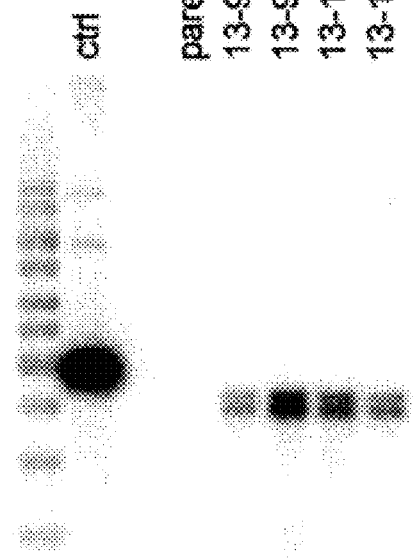
Figure 19C:
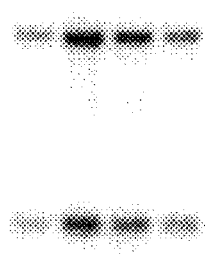

Colonies growing on transformation plates were picked as selective streaks. Clones growing fast as selective streaks were screened by PCR using the primers listed in Table 3.2 for the correct integration using standard laboratory methods. Putative disruptants were purified to single cell clones. Deletion of tsp1 was verified by Southern analyses from these clones (FIG. 19A) using standard laboratory methods described in Example 1 for M181 and M195. All clones were also verified to be single integrants (FIGS. 19B and 19C). One double protease deletion clone (13-172D) was designated with number M194.

TABLE 3.2

Primers for screening removal of pyr4 blaster cassette and for screening tsp1 integration and strain purity.

| Primer | Sequence |
| --- | --- |
| For screening removal of pyr4 blaster cassette from M195 | |
| T083_74156_5a_seq | GATCGACAAAGGTTCCAGCG (SEQ ID NO: 297) |
| T084_74156_3a_seq | AATTGTATCATTCCGAGGCT (SEQ ID NO: 298) |
| For screening integration of pTTv42 | |
| T307_71327_5int | CTGTTTGGCCCTCGAAACT (SEQ ID NO: 299) |
| T032_Bar_loppu_for | CATTGTTGACCTCCACTAGC (SEQ ID NO: 300) |
| T308_71322_3int | TTCGCCATCCAAATTTCTTC (SEQ ID NO: 301) |
| T031_Bar_alku_rev2 | GTTTCTGGCAGCTGGACT (SEQ ID NO: 302) |
| For screening integration of pTTv72 | |
| T307_71322_5int | CTGTTTGGCCCTCGAAACT (SEQ ID NO: 303) |
| T027_Pyr4_orf_start_rev | TGCGTCGCCGTCTCGCTCCT (SEQ ID NO: 304) |
| T308_71322_3int | TTCGCCATCCAAATTTCTTC (SEQ ID NO: 305) |
| T028_Pyr4_flank_rev | CATCCTCAAGGCCTCAGAC (SEQ ID NO 306) |
| For screening deletion a tsp/ORF | |
| T309_71322_5orfpcr | CCCAAGTCGTCTCAGCTCTC (SEQ ID NO: 307) |
| T310_71322_3orfpcr | TCGAAGGCTTCAGTGAGGTAA (SEQ ID NO: 308) |

The double protease deletion strain M194 was used to generate the MAB01 antibody expressing strains M247 and M252 below. Construction of strain M247 was carried out by transforming M194 with MAB01 heavy and light chain constructs (pTTv101+pTTv102). Strain M252 was constructed by transforming M194 with MAB01 heavy and light chain constructs (pTTv99+pTTv67). Both transformations were based on hygromycin and acetamide selection.

Analysis of MAB01 Producing ΔPep1 ΔTsp1 Double Deletion Strain M252

Figure 20:
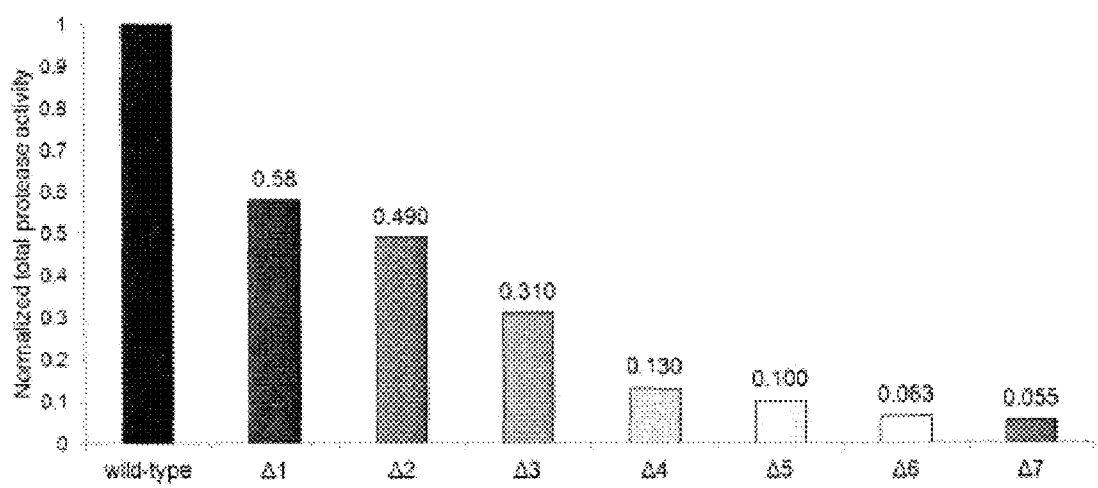
FIG. 20 graphically depicts normalized protease activity data from culture supernatants from each of the protease deletion supernatants and the parent strain M124. Protease activity was measured at pH 5.5 in first 5 strains and at pH 4.5 in the last three deletion strains. Protease activity is against green fluorescent casein. The six protease deletion strain has only 6% of the wild type parent strain and the 7 protease deletion strain protease activity was about 40% less than the 6 protease deletion strain activity.

The MAB01 antibody producing double deletion strain (Δpep1 Δtsp1) was shown to produce 261 mg/l antibody, with 43% full length antibody, when grown in a fermentor. The protease activity of the strain was then tested by growing the strain in Trichoderma minimal medium supplemented with 20 g/l spent grain extract, 60 g/l lactose, and 9 g/l casamino acids at pH 5.5 and 22° C. The total protease activity against casein in this strain was determined to be 2.0-fold less than the wild type M124 strain (FIG. 20).

Identification of the 65 kD Serine Protease SLP1

The protease producing the activity around 65 kD was more difficult to identify due to its low expression level and proximity in size to several highly expressed proteins. The highly expressed proteins were previously identified to be CBHI, CBHII, CIP2, and xylanase 4. Improvements were made to better separate the 65 kD protease from the highly expressed proteins. The improvements included using a lower gel percentage (7%) SDS PAGE gel for zymogram and standard SDS PAGE gels to run the samples a longer time so that the 54 kD molecular weight marker was at the bottom of the gels. Additionally, fermentation supernatant from a *T. reesei* rituximab antibody transformant was also used to purify the serine proteases. The rituximab antibody transformant is strain M169, which produces rituximab and lacks protease deletions. The strain was grown in *Trichoderma* minimal medium supplemented with 20 g/l spent grain extract and 60 g/l lactose at pH 5.5 and 28° C. The CBHI produced in this culture lacks the cellulose binding domain; therefore it is around 10 kD smaller. However, M169 did not show a distinct band corresponding to the 65 kD protease (FIG. 21). Thus, the general region was cut and subjected to in-gel trypsin digestion with sequencing grade modified trypsin (Promega #V5111). The resulting peptides were extracted from the gel and purified by C 18 ZipTip (Millipore #ZTC18M096). The purified peptides were analyzed by LC-MS/MS on a QSTAR Pulsar, ESI-hybrid quadrupole-TOF (AB Sciex).

The peptide analysis showed that the second highest scoring protein was the protease tre51365. The top scoring protein was xylanase4, which was a contaminant in the sample. The tre51365 subtilisin protease, now called SLP1, was found in 3 independent samples from three separate purifications. In the best scoring sample, 6 peptides were found and sequenced by LC-MS/MS. The sequence coverage was 8%, since the native protease gene codes for 882 amino acids that compose a 93 kD protease. In gelatin zymography, a weak band at ~90 kD could be seen along with smearing down to 65 kD suggesting that the SLP1 protease itself undergoes proteolysis but retains much of its activity.

Generation of Sip 1 Deletion Plasmid

The gene encoding SLP1 (slp1) was then deleted in the MAB01 antibody production strain M244 (Δpep1).

The deletion plasmid for the subtilisin-like protease slp1 (TreID51365) was constructed essentially as described for pep1 deletion plasmid pTTv41 in Example 1. 1094 bp of 5' flanking regions and 1247 bp of 3' flanking region were selected as the basis of the slp1 deletion plasmid. Fragments were produced by PCR using the primers listed in Table 3.3. The products were separated with agarose gel electrophoresis and the correct fragments were isolated from the gel with gel extraction kit (Qiagen) using standard laboratory methods. Template used in the PCR of the flanking regions was from the *T. reesei* wild type strain QM6a. The pyr4 blaster cassette was obtained from pTTv71 (Example 1) with NotI digestion. The vector backbone was EcoRI/XhoI digested pRS426 as in Example 1. The plasmid was constructed using the yeast homologous recombination method described in Example 1. This deletion plasmid for slp1 (pTTv126) results in 2951 bp deletion in the slp1 locus and covers the complete coding sequence of SLP1.

TABLE 3.3

Primers for generating slp1 deletion plasmid. Deletion plasmid pTTv126 for slp1 (TreID51365), vector backbone pRS426

| Primer | Sequence |
| --- | --- |
| 5flankfw_vect | GTAACGCCAGGGTTTTCCCAGTCACGACGGTTT AAACATCTCGGAGTGATGCTTCCT (SEQ ID NO: 309) |

TABLE 3.3-continued

Primers for generating slp1 deletion plasmid. Deletion plasmid pTTv126 for slp1 (TreID51365), vector backbone pRS426

| Primer | Sequence |
| --- | --- |
| slp1_5flankrev_pyr4Prom | GCGCTGGCAACGAGAGCAGAGCAGCAGTAGTCG ATGCTAGGCGGCCGCATCAGACGAAACCAGACG AG (SEQ ID NO: 310) |
| slp1_3flankfw_pyr4Term | CAACCAGCCGCAGCCTCAGCCTCTCTCAGCCTC ATCAGCCGCGGCCGCGCGAATCGAGTTGATGAT TC (SEQ ID NO: 311) |
| 3flankrev_vect | GCGGATAACAATTTCACACAGGAAACAGCGTTT AAACCTGGTTGGGATCTGACCACT (SEQ ID NO: 312) |

Generation of MAB01 Producing Δpep1Δslp1 Deletion Strain M298 and M299

To generate the MAB01 antibody producing strain for the second protease deletions, the pep1 deletion strain M181 (in Example 1) was transformed with MAB01 light and heavy chain constructs (pTTv98+pTTv67) using hygromycin and acetamide in selection. The removal of the pyr4 blaster cassette from pep1 locus was carried out essentially as described for M195 above (in generation of double protease deletion strain M219). This pyr4⁻ strain was designated with number M285 and used as the parent for the subsequent protease deletion.

To remove vector sequence, plasmid pTTv126 (Δslp1-pyr4) was digested with PmeI and the correct fragment purified from an agarose gel using QIAquick Gel Extraction Kit (Qiagen). Approximately 5 μg of the slp1 deletion cassette was used to transform M285 (pyr4⁻ of MAB01 antibody strain M244, based on Δpep1 strain M181). Preparation of protoplasts and transformation were carried out using pyr4 selection essentially as described for the pep1 deletion strains M181 and M195 in Example 1.

Colonies growing on transformation plates were picked as selective streaks. Clones growing fast as selective streaks were screened by PCR using the primers listed in Table 3.4 for the correct integration using standard laboratory methods. Putative disruptants were purified to single cell clones.

TABLE 3.4

Primers for screening slp1 integration and strain purity.

| Primer | Sequence |
| --- | --- |
| For screening integration of pTTv126 | |
| T079_slp1_scrn_5forw | GCAGACAAACAGAGCAACGA (SEQ ID NO: 313) |
| T026_Pyr4_orf_5rev2 | CCATGAGCTTGAACAGGTAA (SEQ ID NO: 314) |
| T080_slp1_scrn_3rev | TAGAGGGTGTCGATGGAAGC (SEQ ID NO: 315) |
| T028_Pyr4_flank_rev | CATCCTCAAGGCCTCAGAC (SEQ ID NO: 316) |
| For screening deletion of slp/ORF | |
| T081_slp1_orf_fw | GGTCTCTTCTTTGCCAGCAC (SEQ ID NO: 317) |

TABLE 3.4-continued

Primers for screening slp1 integration
and strain purity.

| Primer | Sequence |
|---|---|
| T082_slp1_orf_rev | TGTCGCTGAACTGAATTTGC (SEQ ID NO: 318) |

Analysis of MAB01 Producing Δpep1Δslp1 Double Deletion Strain M298/M299

Deletion of slp1 in the M244 strain showed an expected improvement in heavy and light chain production (FIGS. 12 and 13). The slp1 deletion strain (Δpep1Δslp1) was grown in a 2 liter shake flask culture containing 300 ml of Trichoderma minimal medium supplemented with 40 g/l lactose, 20 g/l spent grain extract, and 9 g/l casamino acids and buffered to pH 5.5 with 100 mM PIPPS. As described in Example 2 above, the culture supernatants were run on a 4-15% PAGE gel and immunoblotted to detect the MAB01 heavy and light chain. The heavy chain was produced at levels that were 2.8-fold higher than the production levels of the M244 parent strain (FIG. 13). The light chain was produced at levels that were 1.8-fold higher than the production levels of the M244 parent strain (FIG. 13).

Identification of Additional Serine Proteases

Additional antibody degrading serine proteases were identified using other affinity ligands. The soybean trypsin inhibitor (SBTI) effectively stabilizes the antibody heavy and light chain. Therefore, it is able to inhibit proteases that are responsible for cleaving the antibody. Thus, in order to identify these proteases, affinity purification was performed with SBTI coupled to agarose (Sigma #T0637).

The *T. reesei* strain M44 was used to identify the proteases. The M44 strain is a wild type strain with no heterologous protein expression. The M44 strain was grown in *Trichoderma* minimal medium supplemented with 20 g/l spent grain extract and 60 g/l lactose at pH 5.5 and 28° C. A 20 ml sample of M44 culture supernatant from a 217 hour sample was incubated with the SBTI-agarose affinity resin (1 ml) in 30 ml of binding buffer (50 mM Tris, 0.5 M NaCl, pH 7.5) (pH 5.5; 28° C.; 20 g/L spent grain extract, 60 g/L lactose). The supernatant binding buffer mixture was combined in a 50 ml conical tube and agitated at room temperature for 1 hour. The mixture was then added to a glass column and washed with 200 ml of binding buffer. 50 ml of high salt buffer (1 M NaCl) was next used to further remove nonspecific interactions. Finally, the column was washed again with 100 ml of the original binding/wash buffer. The column was then eluted with 0.8 M benzamidine HCl in 50 mM Tris, pH 5.0. The fractions were collected in 0.5 ml volumes and subjected to a protein assay using BioRad Bradford reagent with bovine immunoglobulin as a standard.

Figure 22:
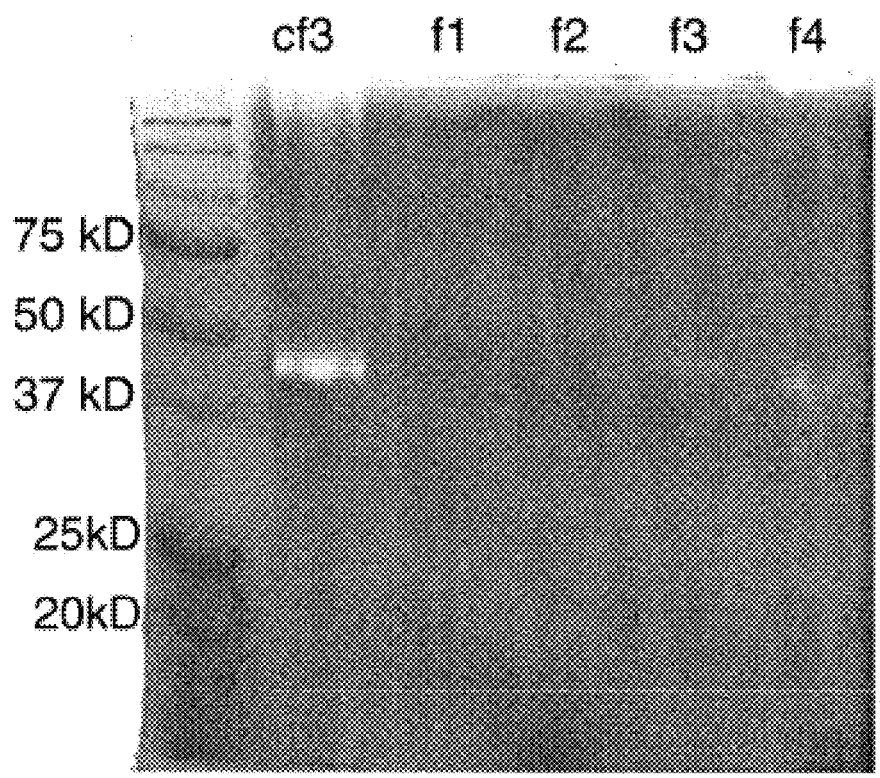
FIG. 22 depicts the results of an MAB02 zymogram assay with SBTI affinity purified fractions containing proteases. The major proteolytic activities appear white, where the protease has degraded the MAB02 antibody. Concentrated fraction 3 (cf3) and unconcentrated fractions 1-4 (f1-f4) were run in the zymogram gel.
Figure 23:
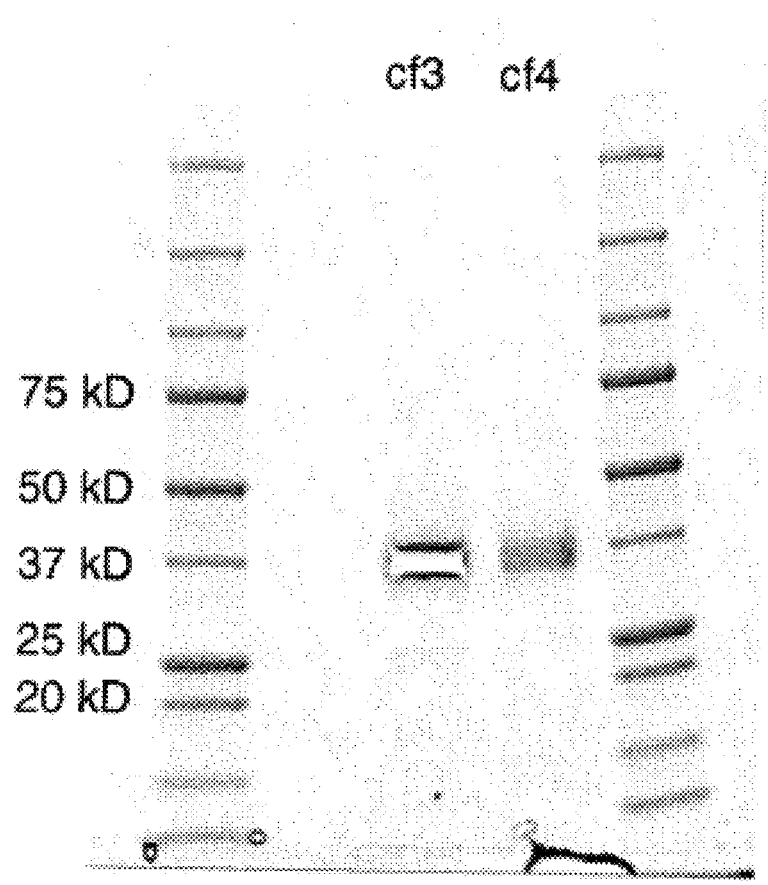
FIG. 23 depicts an SDS PAGE gel showing SBTI affinity purified fractions containing proteases. Concentrated fractions cf3 and cf4 are shown in the gel.

From all the fractions collected, 190 μg of protein was purified from the SBTI affinity column. The peak fraction was washed in a vivaspin ultrafiltration spin filter (Sartoriusstedim) with 10 kD molecular weight cutoff to remove the benzamidine inhibitor and concentrate the fraction. The concentrated fractions (cf3 and cf4) and nonconcentrated fractions (f1-f4) were loaded on an MAB02 zymogram gel (as described above) and on a regular SDS PAGE gel for analysis. The results of the zymogram show that there are two visible proteolytic activities (FIG. 22). The most predominant band was visible around 40 kD and a fainter band was visible around 26 kD (FIG. 22). In the zymogram gel, darker staining protein bands flanked the white zymogram activity band. Comparing this to concentrated fractions loaded on an SDS PAGE gel, these doublet bands could be seen around 38 kD (FIG. 23). The PAGE gel was a 4-15% gradient gel and the zymogram gel was 12%, so the relative sizes can be slightly different. On the PAGE gel, a protein band could clearly be seen in the area of 26 kD, which corresponded to the size of the second fainter zymogram activity.

Figure 24:
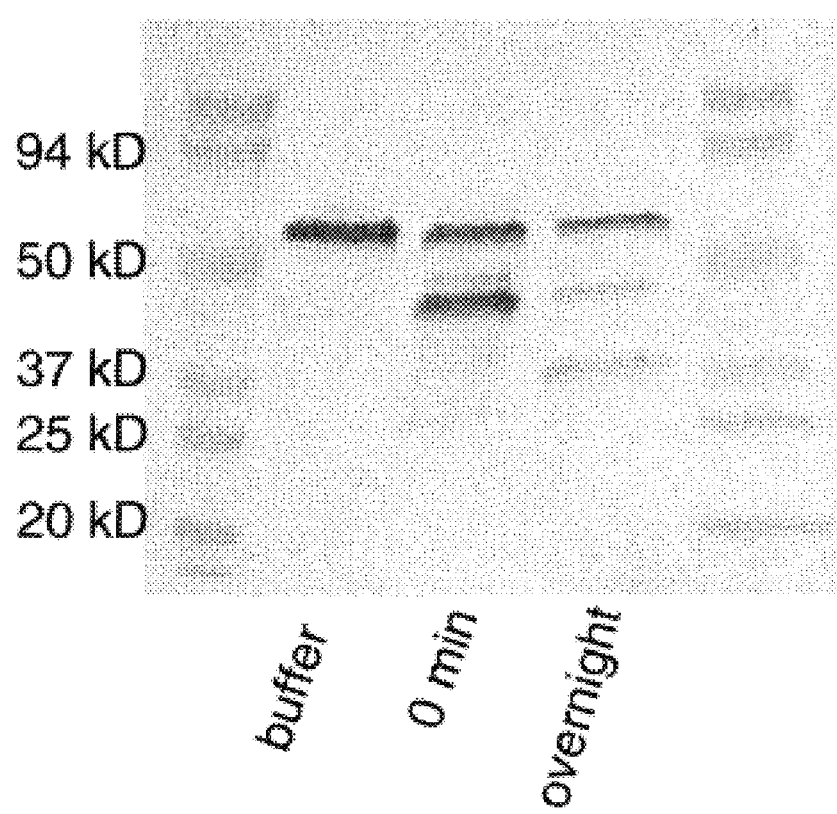
FIG. 24 depicts an immunoblot showing the level of rituximab heavy chain degradation by SBTI purified proteases.

To further analyze the proteolytic activity of the purified protease of cf3, the fraction was tested for its ability to degrade the rituximab antibody heavy chain. A 5 μl sample of cf3 was incubated in sodium citrate buffer pH 5.5 with 0.05 μg ml rituximab. The incubated samples were then analyzed by immunoblotting using an anti-human IgG heavy chain-specific AP conjugated antibody (Sigma #A3188) diluted 1:30,000 in TBST. The results of the immunoblot show that the proteases immediately degraded the rituximab antibody heavy chain. The full length rituximab heavy chain runs at just over 50 kD, while the initial degradation product was around 45 kD (FIG. 24). Additionally, incubation overnight generated an additional product of 38 kD (FIG. 24).

The proteases responsible for the zymogram activities were identified after LC-MS/MS peptide sequencing. Protein containing gel sections were cut out of the SDS PAGE gel shown in FIG. 23 and subjected to in-gel trypsin digestion with sequencing grade modified trypsin (Promega #V5111). The resulting peptides were extracted from the gel and purified by C18 ZipTip (Millipore #ZTC18M096). The purified peptides were analyzed by LC-MS/MS on a QSTAR Pulsar, ESI-hybrid quadrupole-TOF (AB Sciex).

The top scoring protease hit was the subtilisin like protease, slp2 (tre1 23244). Two peptides from slp2 were found and sequenced, covering 6% of the entire sequence length. The full length slp2 protease is 58 kD, but it is usual that the active protease can be smaller in size.

There were also other proteases found in adjacent regions. Analysis of the lower 26 kD region identified the trypsin serine-like protease tsp1 (tre73897). This corresponded to the faint zymogram activity observed. As described above, this protease was identified via aminobenzamidine affinity purification.

In addition, the whole SBTI affinity purified fraction was trypsin digested in solution to determine the entire protease content of the sample. Other identified proteases included the tre123865 protease slp7 (60 kD); the tre77579 protease pep4 (42 kD); and the tre58698 protease slp8 (41 kD).

Figure 25A:
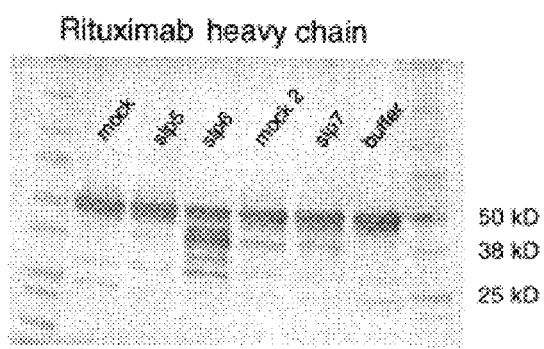
FIGS. 25A-B depict an immunoblot showing the level of antibody degradation when incubated overnight with subtilisin containing *Pichia* supernatants.
Figure 25B:
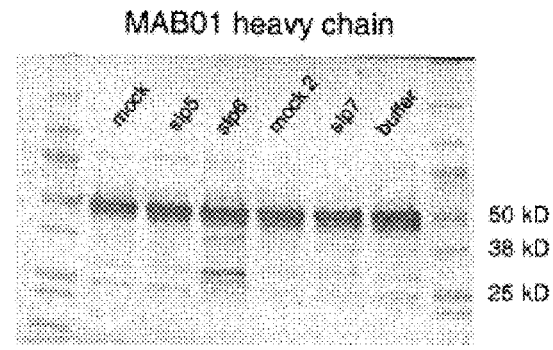

The *Trichoderma reesei* subtilisin proteases slp5, slp6, and slp7 were overproduced in *Pichia* supernatants for investigation of their activity against the antibody rituximab and MAB01 heavy chains (FIG. 25). The rituximan mock supernatant was compared to supernatants containing slp5 and slp6 (FIG. 25 A). The MAB01 mock supernatant was compared to supernatants containing slp7 (FIG. 25B). Rituximab and MAB01 were added to the protease-containing *Pichia* supernatants and incubated overnight at 37° C. Samples were taken and analyzed by immunoblotting with an anti-heavy chain AP conjugated antibody. This analysis revealed that the slp6 protease showed heavy degradation activity on the rituximab heavy chain and light degradation of the MAB01, compared to the mock control supernatants (FIG. 25).

Generation of Slp2 and Sip 3 Deletion Plasmids

Based on the above results, the slp2 and slp3 protease genes were each deleted from the MAB01 antibody producing strain M244.

The deletion plasmids for the subtilisin-like proteases slp2 (TreID 123244) and slp3 (TreID 123234) were constructed essentially as described for pep1 deletion plasmid pTTv41 in Example 1. 1000 bp of 5' and 1100 bp of 3' flanking regions were selected as the basis of the slp2 deletion plasmid. For slp3, 1000 bp of 5' and 1100 bp of 3' flanking regions were selected. Fragments were produced by PCR using the primers listed in Table 3.5. The products were separated with agarose gel electrophoresis and the correct fragments were isolated from the gel with gel extraction kit (Qiagen) using standard laboratory methods. Template used in the PCR of the flanking regions was from the *T. reesei* wild type strain QM6a. The pyr4 blaster cassette was obtained from pTTv71 (Example 1) with NotI digestion. The vector backbone was EcoRI/XhoI digested pRS426 as in Example 1. The plasmids were constructed using the yeast homologous recombination method described in Example 1. The deletion plasmid for slp2 (pTTv1 15) results in a 2114 bp deletion in the slp2 locus and covers the complete coding sequence of SLP2. The deletion plasmid for slp3 (pTTv1 16) results in a 1597 bp deletion in the slp3 locus and covers the complete coding sequence of SLP3.

TABLE 3.5

Primers used for plasmids.

| Primer | Sequence |
|---|---|
| Deletion plasmid pTTv115 for slp2 (TreID123244), vector backbone pRS426 | |
| JJ-037 primer | GATTAAGTTGGGTAACGCCAGGGTTTTCCCAGTCACGACGGTTTAAACGCAGTCTATCCCATCCCTG (SEQ ID NO: 319) |
| JJ-038 primer | GCGCTGGCAACGAGAGCAGAGCAGCAGTAGTCGATGCTAGGCGGCCGCGCGGATGATGAAGGAAGAAG (SEQ ID NO: 320) |
| JJ-039 primer | CAACCAGCCGCAGCCTCAGCCTCTCTCAGCCTCATCAGCCGCGGCCGCAACAGCTGTTCGCACGCGTG (SEQ ID NO: 321) |
| JJ-040 primer | TGGAATTGTGAGCGGATAACAATTTCACACAGGAAACAGCGTTTAAACGGCTGGGCATTGGGGCCG (SEQ ID NO: 322) |
| Deletion plasmid pTTv116 for slp3 (TreID123234), vector backbone pRS426 | |
| JJ-041 primer | GATTAAGTTGGGTAACGCCAGGGTTTTCCCAGTCACGACGGTTTAAACAAACAAGGCACAAAGGCCTG (SEQ ID NO: 323) |
| JJ-042 primer | GCGCTGGCAACGAGAGCAGAGCAGCAGTAGTCGATGCTAGGCGGCCGCATCCAAGGATGAGGAGAAC (SEQ ID NO: 324) |
| JJ-043 primer | CAACCAGCCGCAGCCTCAGCCTCTCTCAGCCTCATCAGCCGCGGCCGCACCTAATGGTTTCTTCGTTTTTC (SEQ ID NO: 325) |
| JJ-044 primer | TGGAATTGTGAGCGGATAACAATTTCACACAGGAAACAGCGTTTAAACCGGTCCGAAGGGTGTTTTGG (SEQ ID NO: 326) |

Generation of MAB01 Producing Δpep1Δslp2 and Δpep1Δslp3 Deletion Strains M292 and M295

To generate the MAB01 antibody producing strain for the second protease deletions, the pep1 deletion strain M181 (in Example 1) was transformed with MAB01 light and heavy chain constructs (pTTv98+pTTv67) using hygromycin and acetamide in selection. The removal of the pyr4 blaster cassette from pep1 locus was carried out essentially as described for M195 above (in generation of double protease deletion strain M219). This pyr4⁻ strain was designated with number M285 and used as the parent for the subsequent protease deletions.

To remove vector sequence, plasmids pTTv1 15 (Δslp2-pyr4) and pTTv1 16 (Δslp3-pyr4) were digested with PmeI and the correct fragments purified from an agarose gel using QIAquick Gel Extraction Kit (Qiagen). Approximately 5 μg of either deletion cassette was used to transform M285 (pyr⁻ of MAB01 antibody strain M244, based on Δpep1 strain M181) separately. Preparation of protoplasts and transformation were carried out using pyr4 selection essentially as described for the pep1 deletion strains M181 and M195 in Example 1.

Colonies growing on transformation plates were picked as selective streaks. Clones growing fast as selective streaks were screened by PCR using the primers listed in Table 3.6 for the correct integration using standard laboratory methods. Putative disruptants were purified to single cell clones. No pure clones were obtained even after repeated purification steps.

TABLE 3.6

Primers for screening slp2 (pTTv115) and slp3 (pTTv116) integration and strain purity.

| Primer | Sequence |
|---|---|
| For screening integration a pTTv115 | |
| T054_slp2_5screen_F | GATGCACCGCTGCGGCC (SEQ ID NO: 327) |
| T026_Pyr4_orf_5rev2 | CCATGAGCTTGAACAGGTAA (SEQ ID NO: 328) |
| T028_Pyr4_flank_rev | CATCCTCAAGGCCTCAGAC (SEQ ID NO: 329) |
| T055_slp2_3screen_R | GGCGTTGCTCCCCATGCG (SEQ ID NO: 330) |
| For screening deletion of slp2 ORF | |
| T111_slp2_ORF_F | ATGCGGTCCGTTGTCGCC (SEQ ID NO: 331) |
| T112_slp2_ORF_R | TTACTCGGAGAGCTCAGAGA (SEQ ID NO: 332) |
| For screening integration of pTTv116 | |
| T056_slp3_5screen_F | GTGAATGGGTGGCAACATGA (SEQ ID NO: 333) |
| T026_Pyr4_orf_5rev2 | CCATGAGCTTGAACAGGTAA (SEQ ID NO: 334) |
| T028_Pyr4_flank_rev | CATCCTCAAGGCCTCAGAC (SEQ ID NO: 335) |
| T057_slp3_3_screen_R | CATCAAGTTGACCACCATTGT (SEQ ID NO: 336) |
| For screening deletion of slp3 ORF | |
| T113_slp3_ORF_F | ATGCGGTTGTCCGTCCTCC (SEQ ID NO: 337) |
| T114_slp3_ORF_R | TTAACCGGAAGGGTTGCCGT (SEQ ID NO: 338) |

Analysis of MAB01 Producing Δpep1Δslp2 and Δpep1Δslp3 Double Deletion Strains M292 and M295

The M292 strain (Δpep1Δslp2) and M295 strain (Δpep1Δslp3) were grown along with their sister transformants in a 2 liter shake flask culture containing 300 ml of Trichoderma minimal medium supplemented with 40 g/l lactose, 20 g/l spent grain extract, and 9 g/l casamino acids and buffered to pH 5.5 with 100 mM PIPPS. The culture supernatants were run on a 4-15% SDS PAGE gel and immunoblot analysis was performed to detect the MAB01 heavy chain and light chain. The results show that both deletions improved MAB01 stability (FIGS. 12 and 13). The Δslp2 deletion improved MAB01 heavy chain expression in shake flask culture by about 2.4-fold on day 7, as compared to the parent M244 strain (FIG. 13). The Δslp3 improved MAB01 heavy chain expression in large shake flasks by about 1.5-fold and MAB01 light chain expression by about 1.7-fold as compared to the M244 parent strain (FIG. 13). Moreover, when compared to Δslp3 and Δgap1, Δslp2 showed the highest fold increased in MAB01 heavy chain expression relative to MAB01 heavy chain expression in the M244 parent strain (FIG. 13).

When slp2 was deleted from the M306 multiple deletion strain (Δpep1 Δtsp1Δslp1), deletion of slp2 resulted in a reduction in sporulation and slower growth as compared to the parent strain.

Example 4—Trichoderma Multiple Protease Deletion Strains

This example demonstrates increased antibody production and stability from Trichoderma reesei (T. reesei) strains containing multiple deletions of the protease genes identified above in Examples 1-3.

Generation of Triple Deletion Strain Δpep1 Δtsp1Δslp1

A T. reesei strain having a triple deletion Δpep1 Δtsp1Δslp1 was generated and tested for improvement in antibody production. The strain was also used for further rounds of protease deletions. Generation of triple protease deletion strain M277

To generate a marker-free triple protease deletion strain, the looping out of the pyr4 marker was applied to strain M219 essentially as described above for looping out pyr4 from the single protease deletion strain Δpep1. Three consecutive 5-FOA selection steps were carried out to ensure that the clones selected were originating from single cells. Final clones were verified for the looping out of pyr4 by PCR (using the primers listed in Table 3.1); no specific signals were seen with primers annealing with the looped out part of the pyr4. The looping out was further verified by plating the clones onto minimal medium plates with or without 5 mM uridine. The clone used to generate the triple protease deletion strain was designated with strain number M228 (Δpep1 Δtsp1, pyr4⁻).

The deletion plasmid pTTv126 for the third protease gene, subtilisin-like protease slp1 (TreID51365) is described above (Table 3.3). This deletion plasmid results in 2951 bp deletion in the slp1 locus and covers the complete coding sequence of SLP1.

To remove vector sequence, plasmid pTTv126 (Δslp1-pyr4 loopout) was digested with PmeI and the correct fragment purified from an agarose gel using QIAquick Gel Extraction Kit (Qiagen). Approximately 5 μg of the slp1 deletion cassette was used to transform M228 (Δpep1 Δtsp1, pyr4⁻) above. Preparation of protoplasts and transformation were carried out essentially as described in Example 1 for the strains M181 and M195 using pyr4 selection.

Figure 26A:
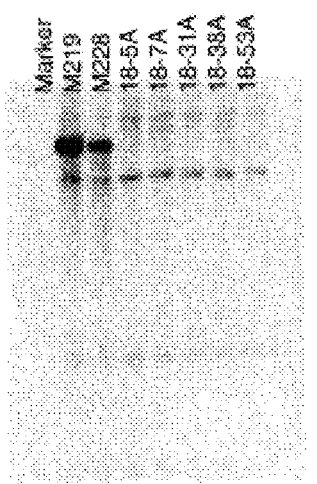
FIGS. 26A-C depict Southern blot analysis showing the generation of the triple protease deletion strain M277.
Figure 26B:
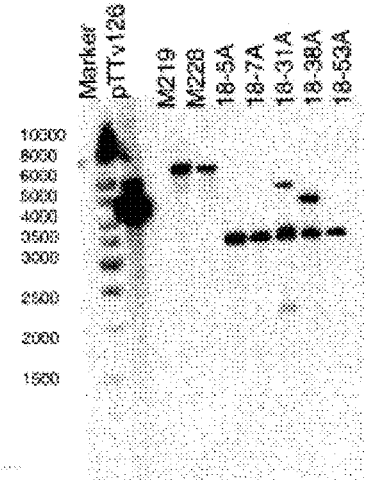
Figure 26C:
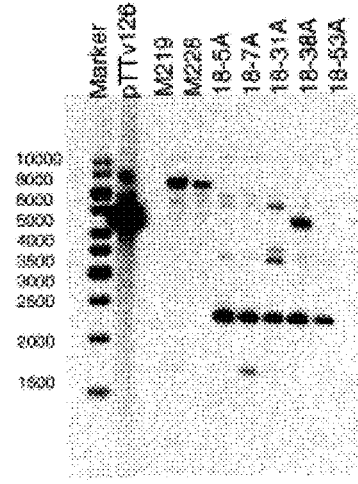

200 clones were picked as first streaks. 48 of these streaks were screened by PCR using the primers listed in Table 4.1 for the correct integration using standard laboratory methods. Five putative triple protease disruptants (Δpep1 Δtsp1Δslp1) were purified to single cell clones. Deletion of slp1 was verified by Southern analyses of the five clones (FIG. 26A). Southern analyses were performed as described in Example 1. Southern analyses also verified that three of the clones were single integrants (FIGS. 26B and 26C). The two other clones were shown to carry additional copies somewhere else in the genome and were discarded. The clone used in removal of the pyr4 blaster cassette (and to generate the quadruple protease deletion strain M307 below) was designated with strain number M277 (Δpep1 Δtsp1Δslp1).

TABLE 4.1

Primers for screening removal of pyr4 blaster cassette and for screening slp1 integration and strain purity.

| Primer | Sequence |
| --- | --- |
| For screening removal of pyr4 blaster cassette from M219 | |
| T307_71322_5int | CTGTTTGGCCCTCGAAACT (SEQ ID NO: 339) |
| T026_Pyr4_orf_5rev2 | CCATGAGCTTGAACAGGTAA (SEQ IDNO: 340) |
| T308_71322_3int | TTCGCCATCCAAATTTCTTC (SEQ ID NO: 341) |
| T028_Pyr4_flank_rev | CATCCTAAGGCCTCAGAC (SEQ ID NO: 342) |
| For screening integration a pTTv126 | |
| T079_slp1_scrn_5forw | GCAGACAAACAGAGCAACGA (SEQ ID NO: 343) |
| T026_Pyr4_orf_5rev2 | CCATGAGCTTGAACAGGTAA (SEQ ID NO: 344) |
| T080_slp1_scrn_3rev | TAGAGGGTGTCGATGGAAGC (SEQ ID NO: 345) |
| T028_Pyr4_flank_rev | CATCCTAAGGCCTCAGAC (SEQ ID NO: 346) |
| For screening deletion of slp1ORF | |
| T081_slp1_orf_fw | GGTCTCTTCTTTGCCAGCAC (SEQ IDNO: 347) |
| T082_slp1_orf_rev | TGTCGCTGAACTGAATTTGC (SEQ ID NO: 348) |

Generation of MAB01 Producing Triple Protease Deletion Strain M304

To generate the MAB01 antibody producing strain for the third protease deletion, the pep1tsp1 double protease deletion strain M194 (Example 3) was transformed with MAB01 light and heavy chain constructs (pTTv99+pTTv67) using hygromycin and acetamide in selection. This MAB01 strain with pep/tsp1 double, deletion was designated with number M252. Removal of the pyr4 blaster cassette from pep1 locus was carried out essentially as described in Example 3 for M195 (in generation of double protease deletion strain M219). This pyr4⁻ strain was designated with number M284 and used as the parent for the subsequent protease deletion.

The third protease deletion to M284 was obtained by using slp1 deletion construct pTTv128. This construct contains a native KEX2 overexpression cassette targeted to the slp1 locus. Transformation was carried out essentially according to the protocol described in Example 1 for the strains M181 and M195 using pyr4 selection. The resulting strain is the MAB01 producing triple protease deletion strain M304.

Analysis of MAB01 Producing Triple Protease Deletion Strain M304

The triple protease deletion (Δpep1 Δtsp1Δslp1) MAB01 antibody producing strain M304 was shown to produce the MAB01 antibody at yields of up to 3.5 g/L in culture (pH 5,5; 28→22° C.; 60 g/L spent grain, 30 g/L glucose, 60 g/L lactose+lactose feed), and product quality up to 84% of full length IgG (see Example 6 below). The protease activity of the strain was also tested by growing the strain in Trichoderma minimal medium supplemented with 60 g/l solid spent grain, 30 g/l glucose, and 60 g/l lactose at pH 5.5. The culture was grown up at 30° C. and then shifted to 22° C. for the production phase. The fedbatch cultivation was done with a lactose feed. The total protease activity against casein in this strain was determined to be about 3.2-fold less compared to the wild type strain M124 (FIG. 20).

Comparison of Single, Double, and Triple Deletion Strains

The relative protease activity of culture supernatants from the single protease deletion (Δpep1) strain M181 (see Example 1), the double protease deletion (Δpep1 Δtsp1) strain M219 (see Example 3), and the triple protease deletion (Δpep1 Δtsp1Δslp1) strain M277 were compared. These deletion strains were compared to the wild type strain M124. The three protease deletion strains were grown in 2 liter shake flasks with 300 ml TrMM containing 40 g/l lactose, 20 g/l spent grain extract, and 100 mM PIPPS at pH 5.5. Samples were taken on days 3, 5, 7, and 10. Day 7 culture supernatant samples from M124, M181, M219, and M277 were each diluted 1:2 in sodium citrate buffer (50 mM, pH 5.5) and 30 μl were loaded on a 12% zymogram SDS PAGE gel containing MAB02. The SDS PAGE gel was run at 100V for 45 minutes. The gel was then incubated in 2.5% Triton X-100 for one hour, before being washed several times with the reaction buffer (50 mM sodium citrate, pH 5.5). The zymogram gel was then left overnight shaking in the reaction buffer. The next morning the gel was stained with GelCode Blue staining reagent. Regions where the MAB02 antibody has been degraded showed up as white spots on the blue stained gel.

Figure 27:
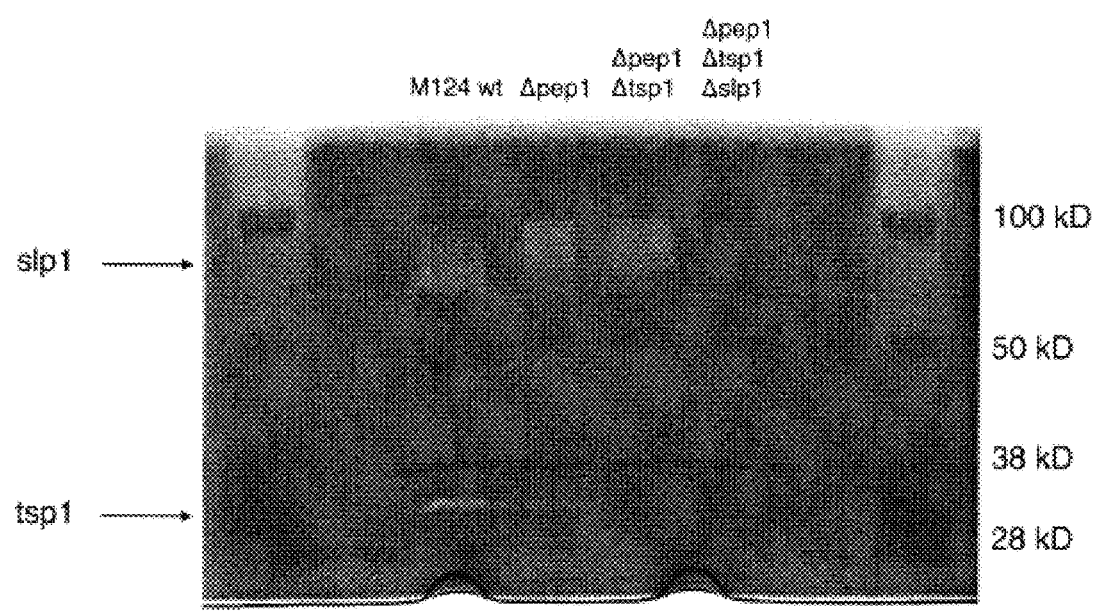
FIG. 27 depicts an MAB02 zymogram assay showing the activity of protease deletion strain supernatants. White regions on the stained gel indicate an area of protease activity.

Two protease activities were seen in the control M1 24 and the M1 81 Δpep1 samples (FIG. 27). The most predominate activity was seen between 65-90 kD, which corresponds to slp1. A fainter activity was seen around 28 kD, which corresponds to tsp1. As was expected, the M219 Δpep1 Δtsp1 strain did not produce a zymogram band at 28 kD. Likewise, the M277 Δpep1 Δtsp1Δslp1 strain did not produce either zymogram activity. The active size of slp1 appears to be variable, since it was still active when it was cleaved down to 65 kD even though its mature size is 90 kD. The size variation can be seen in FIG. 27.

Figure 28:
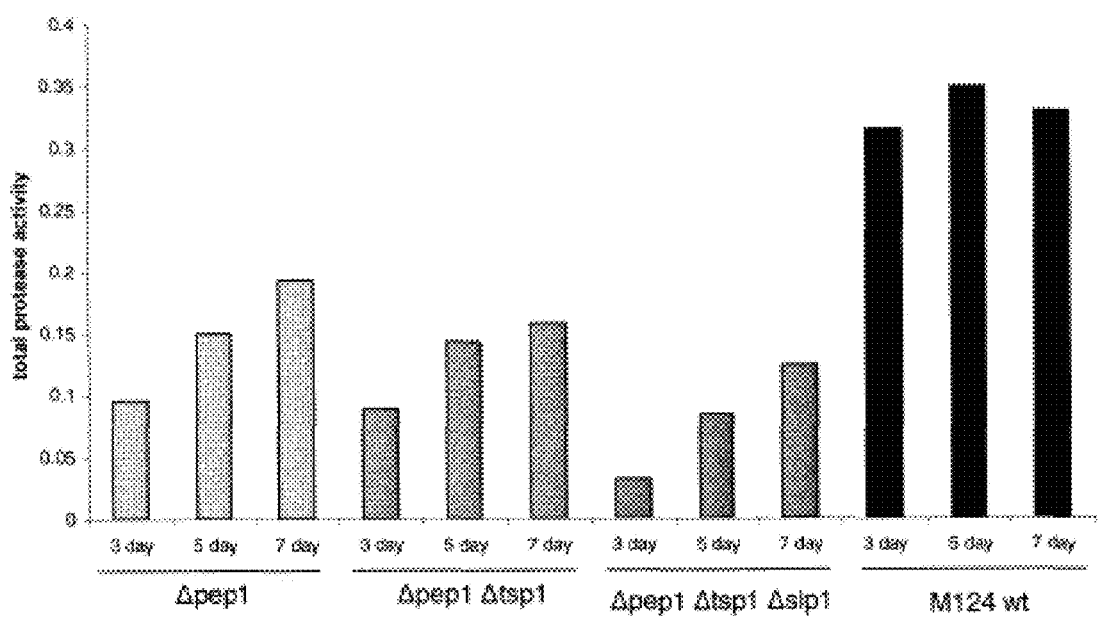
FIG. 28 graphically depicts total protease activity of protease deletion culture supernatants compared to wild type M1 24 activity.

The total protease activity against succinylated casein from supernatant cultures of the M181, M219, and M277 deletion strains was also measured from day 3, day 5, and day 7 samples. The supernatants were first diluted to 2 mg/ml total protein in 50 mM sodium citrate, pH 5.5 before being assayed. 50 μl of diluted supernatant was loaded into a 96 well plate and 50 μl of succinylated casein was added to begin the reaction. A background control with buffer instead of casein was used for each sample. After the addition of casein the protease reaction was allowed to proceed for 1 hour at 37° C. To develop the reaction 50 μl of TNBSA reagent was added to every well and the plate incubated for 16 hours at 37° C. The absorbance at 450 nm was measured for the whole plate. The nonspecific background signal is subtracted from specific protease activity measurement. As shown in FIG. 28, the supernatant samples from the three protease deletion strains contained less protease activity than the M124 wild type strain.

Figure 41:
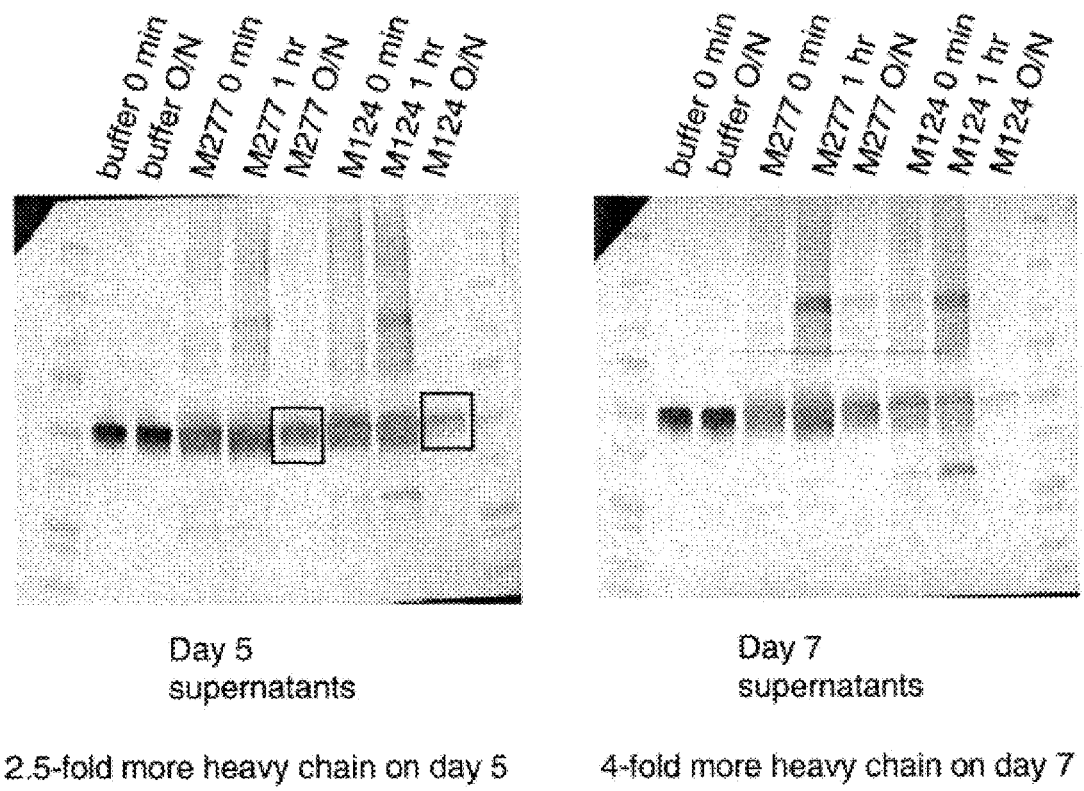
FIG. 41 depicts an immunoblot showing reduced MAB01 heavy chain degradation after overnight incubation with supernatant from the triple protease deletion strain M277. After overnight incubation in day 5 culture supernatant, there was 2.5-fold more heavy chain found in the triple protease deletion supernatant compared to supernatant from control strain M124, which has no protease deletions. When incubated with the 7 day culture supernatant, there was 4-fold more heavy chain found in the triple protease deletion supernatant compared to supernatant from control strain M124.

The supernatant from the M277 and M124 cultures (day 5 and 7) was diluted to 6 mg/ml in 50 mM sodium citrate buffer. To these diluted supernatants the MAB01 antibody was spiked in to a final concentration of 0.05 μg μl. These reactions were incubated at 37° C. overnight. The reactions were sampled at zero time, 1 hour, and over overnight incubation. The 20 μl samples were loaded into a 4-15% SDS PAGE gel and run at 200 volts for 40 minutes. The gel was transferred at 100 volts for 1 hour to nitrocellulose for immunoblotting. The membrane was blocked with 5% milk in TBST for one hour. The heavy chain of MAB01 was detected with an anti-heavy chain AP conjugated antibody (Sigma #A3188) diluted 1:30,000 in TBST. After washing the membrane with TBST, the blot was developed with AP substrate (Promega). Comparing the overnight incubated samples it was clearly evident that the heavy chain degraded more in the M124 strain supernatant. The M124 contains no protease deletions. With 3 protease deletions, the M277 strain produced MAB01 heavy chain that was significantly stabile. On day 5, there was 2.5-fold more heavy chain in the M277 supernatant after overnight incubation. With the day 7 supernatant, there was 4-fold more heavy chain visible (FIG. 41).

Quadruple Deletion Strain M307

The M307 strain having a quadruple deletion Δpep1 Δtsp1Δslp1Δgap1 was generated and used for further rounds of protease deletions.

Generation of Quadruple Protease Deletion Strain M307

To generate a marker-free quadruple protease deletion strain, removal of the pyr4 blaster cassette was applied to strain M277 essentially as described in Example 3 for removal of the pyr4 blaster cassette from the single protease deletion strain M195 (Δpep1). Three consecutive 5-FOA selection steps were carried out to ensure that the clones selected were originating from single cells. Final clones were verified for the removal of the blaster cassette by PCR using the primers listed in Table 4.2 with standard laboratory methods. No specific signals were seen with primers annealing with the removed part of the pyr4. Removal was further verified by plating the clones onto minimal medium plates with or without 5 mM uridine. No growth was observed on the plates without uridine supplementation. The clone used to generate the quadruple protease deletion strain was designated with strain number M306 (Δpep1 Δtsp1Δslp1, pyr4⁻).

The deletion plasmid pTTv1 17 for the fourth protease gene, glutamic protease gap1 (TreID69555) is described in Example 2 (Table 2.1). This deletion plasmid results in a 1037 bp deletion in the gap1 locus and covers the complete coding sequence of Gap1.

To remove vector sequence, plasmid pTTv1 17 (Δgap1-pyr4) was digested with PmeI and the correct fragment purified from an agarose gel using QIAquick Gel Extraction Kit (Qiagen). Approximately 5 μg of the gap1 deletion cassette was used to transform M306 (Δpep1 Δtsp1Δslp1, pyr4⁻) above. Preparation of protoplasts and transformation were carried out essentially as described in Example 1 for the strains M181 and M195 using pyr4 selection.

Figure 29A:
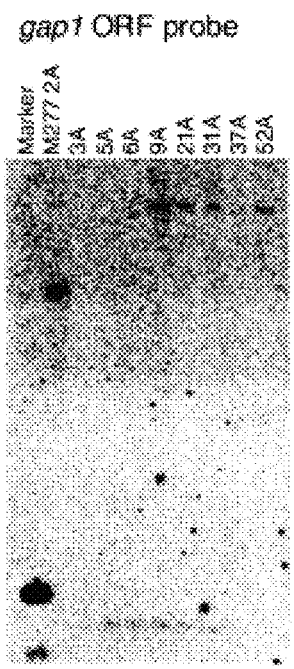
FIGS. 29A-C depict Southern blots analysis showing the generation of the quadruple protease deletion strain M307.
Figure 29B:
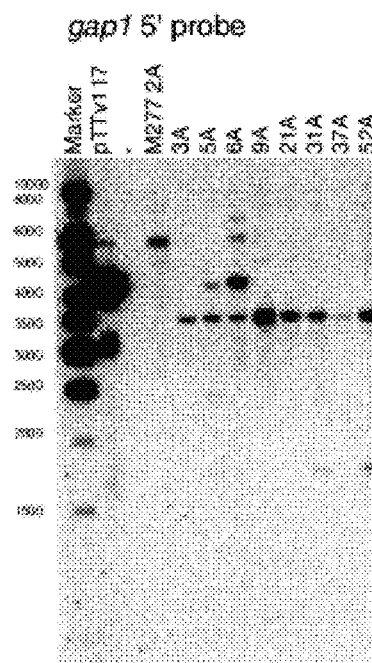
Figure 29C:
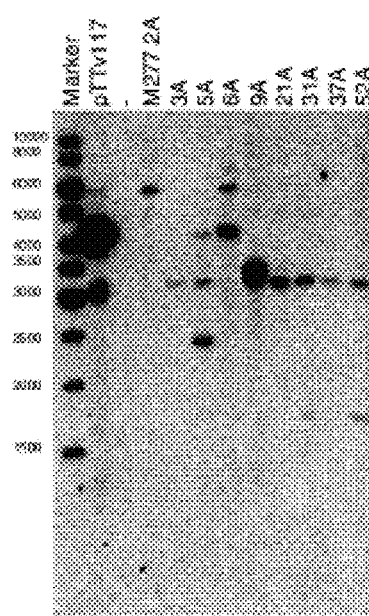

150 clones were picked as first streaks. 48 of these streaks were screened by PCR using the primers listed in Table 4.2 for the correct integration using standard laboratory methods. Eight putative quadruple protease disruptants (Δpep1 Δtsp1Δslp1Δgap1) were purified to single cell clones. Deletion of gap1 was verified by Southern analyses of the eight clones (FIG. 29 A). Southern analyses were performed as described in Example 1. Southern analyses also verified that three of the clones were single integrants (FIGS. 29B and 29C). The five other clones were shown to carry additional copies somewhere else in the genome and were discarded. The clone used in removal of the pyr4 blaster cassette (and to generate the quintuple protease deletion strain M369 below) was designated with strain number M307 (Δpep1 Δtsp1Δslp1Δgap1).

TABLE 4.2

Primers for screening removal of pyr4 blaster cassette and for screening gap1 integration and strain purity.

| Primer | Sequence |
| --- | --- |
| For screening removal of pyr4 blaster cassette from M277 | |
| T079_slp1_scrn_5forw | GCAGACAAACAGAGCAACGA (SEQ ID NO: 349) |
| T026_Pyr4_orf_5rev2 | CCATGAGCTTGAACAGGTAA (SEQ ID NO: 350) |
| T080_slp1_scrn_3rev | TAGAGGGTGTCGATGGAAGC (SEQ ID NO: 351) |
| T028_Pyr4_flank_rev | CATCCTCAAGGCCTCAGAC (SEQ ID NO: 352) |
| For screening integration of pTTv117 | |
| T052_gap1_5screen_F | CTCAGAAAGGTTGTAGTTGTGA (SEQ ID NO: 353) |
| T026_Pyr4f_orf_5rev2 | CCATGAGCTTGAACAGGTAA (SEQ ID NO: 354) |
| T053_gap1_3screen_R | GATGTTGTGTTTTCAGTCTGCA (SEQ ID NO: 355) |
| T028_Pyr4_flank_rev | CATCCTCAAGGCCTCAGAC (SEQ ID NO: 356) |
| For screening deletion of gap/ORF | |
| T109_gap1_ORF_F | ATGTTCATCGCTGGCGTCG (SEQ ID NO: 357) |
| T110_gap1_ORF_R | CTAAACGTAAGAGCAGGTCAA (SEQ ID NO: 358) |

Generation of MAB01 Producing Quadruple Protease Deletion Strain M371

To generate quadruple protease deletion strain with MAB01 antibody production, removal of the pyr4 blaster cassette from slp1 locus from strain M304 was carried out essentially as described in Example 3 for M195 (in generation of double protease deletion strain M219). This pyr4⁻ strain was designated with number M317 and used as the parent for the subsequent protease deletion.

The fourth protease deletion to M317 was obtained by using gap1 deletion construct pTTv117 above. Transformation was carried out essentially according to the protocol described in Example 1 for the strains M181 and M195 using pyr4 selection. The resulting strain is the MAB01 producing quadruple protease deletion strain M371.

Analysis of Quadruple Protease Deletion Strain

Figure 30:
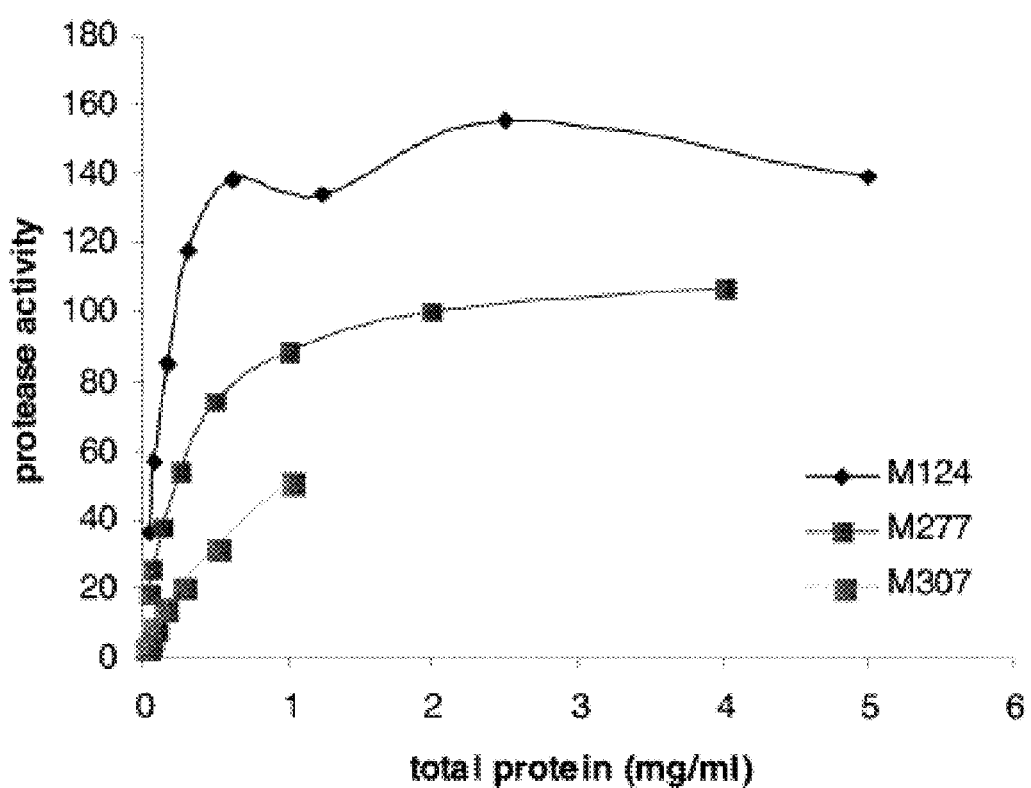
FIG. 30 graphically depicts total protease activity in triple and quadruple deletion strains compared to wild type M1 24 strain.

The total protease activity of culture supernatant from the quadruple deletion strain M307 was then measured and compared with culture supernatants from the triple deletion strain M277 and the wild type strain M124. Each strain was grown in 2 liter shake flasks with 300 ml TrMM containing 40 g/l lactose, 20 g/l spent grain extract, and 100 mM PIPPS at pH 5.5. Day 7 supernatant samples were taken for total protease assay. The total protein concentrations of the supernatants were measured using the BCA assay with bovine immunoglobulin as the standard. The supernatants were diluted serially 1:2 in sodium citrate buffer at pH 5.5. The diluted supernatants were added to fluorescently labeled casein substrate and incubated at 37° C. The fluorescence was measured after 1 hour at 485 nm excitation and 530 nm emission. The results showed that rate of protease activity of the triple deletion strain M277 was 3 times less than the wild type strain M124 and the quadruple deletion strain M307 was 8 times less than the wild type strain M124 (FIG. 30).

Additionally, FIG. 20 summarises the total protease activity against casein from the M188 single deletion strain, the M219 double deletion strain, the M277 triple deletion strain, and the M307 quadruple deletion strain as compared to the wild type M124 strain. The pep1 single deletion reduced the protease activity by 1.7-fold, the pep1/tsp1 double deletion reduced the protease activity by 2-fold, the pep1/tsp1/slp1 triple deletion reduced the protease activity by 3.2-fold, and the pep1/tsp1/slp1/gap1 quadruple deletion reduced the protease activity by 7.8-fold compared to the wild type M124 strain (FIG. 20).

The MAB01 antibody producing strain M371 contains a quadruple deletion Δpep1 Δtsp1Δslp1Δgap1. The strain was grown in the fermentor and compared to the triple deletion MAB01 producing strain under the same conditions. The batch cultivation was performed with the M371 strain that produced MAB01 and was with pep1, tsp1, slp1, and gap1 protease deletions and kex2 overexpression. The strain was grown in *Trichoderma* minimal medium supplemented with 40 g/l solid spent grain, 40 g/l glucose, and 40 g/l lactose at pH 5.5. The culture was grown up at 30° C. and then shifted to 22° C. for the production phase. The batch cultivation was performed with the M304 strain that produced MAB01 and was with pep1, tsp1, and slp1 protease deletions and kex2 overexpression. The strain was grown in minimal medium supplemented with 40 g/l solid spent grain, 40 g/l glucose, and 40 g/l lactose at pH 5.5. The culture was grown up at 30° C. and then shifted to 22° C. for the production phase.

Figure 31:
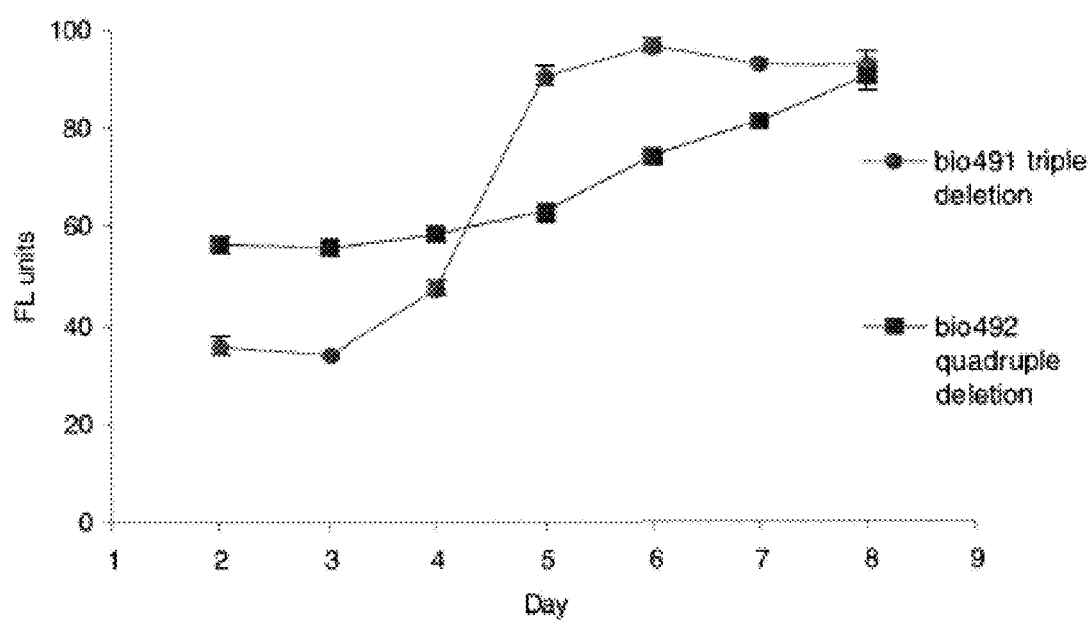
FIG. 31 graphically depicts protease activity over time between the M304 triple deletion strain and the M371 quadruple deletion strain.

The full length antibody yield calculated was 20% higher in the gap1 deletion strain from the day 6 sample. Under the same conditions, the quadruple deletion strain produced 1.9 g/L (897 mg/L full length antibody) and the triple deletions strain produced 1.3 g/L (731 mg/L full length antibody). From the fermentor supernatants, the total protease activity against casein was measured. The supernatant samples were diluted in sodium citrate buffer pH 5.5 so that the total protein concentration was 0.15 mg/ml for all samples. To this diluted supernatant 10 μg ml BODIPY casein was added to begin the protease assay. Samples from each day of the cultivation were compared between the two different strains. The results show that there was up to 30% less total protease activity in the gap1 deletion strain on day 5 (FIG. 31). On day 6, the protease activity was 20% lower, which correlates to the 20% improvement in antibody yield on that day.

Quintuple Deletion Strain

The M369 strain having a quintuple deletion Δpep1 Δtsp1Δslp1Δgap1Δgap2 was generated and used for further rounds of protease deletions.

Generation of Quintuple Protease Deletion Strain M369

To generate a marker-free quintuple protease deletion strain, removal of the pyr4 blaster cassette was applied to strain M307 essentially as described in Example 3 for removal of the pyr4 blaster cassette from the single protease deletion strain M195 (Δpep1). Three consecutive 5-FOA selection steps were carried out to ensure that the clones selected were originating from single cells. Final clones were verified for the removal of the blaster cassette by PCR using the primers listed in Table 4.3 with standard laboratory methods. No specific signals were seen with primers annealing with the removed part of the pyr4 blaster cassette. Removal was further verified by plating the clones onto minimal medium plates with or without 5 mM uridine. No growth was observed on the plates without uridine supplementation. The clone used to generate the quintuple protease deletion strain was designated with strain number M321 (Δpep1 Δtsp1Δslp1Δgap1, pyr4).

The deletion plasmid pTTv145 for the fifth protease gene, glutamic protease gap2 (TreID106661) is described in Example 2 (Table 2.3). This deletion plasmid results in a 944 bp deletion in the gap2 locus and covers the complete coding sequence of GAP2.

To remove vector sequence, plasmid pTTv145 (Δgap2-pyr4 loopout) was digested with PmeI and the correct fragment purified from an agarose gel using QIAquick Gel Extraction Kit (Qiagen). Approximately 5 μg of the gap2 deletion cassette was used to transform M321 (Δpep1 Δtsp1Δslp1Δgap1, pyr4⁻) above. Preparation of protoplasts and transformation were carried out essentially as described in Example 1 for the strains M181 and M195 using pyr4 selection.

Figure 32A:
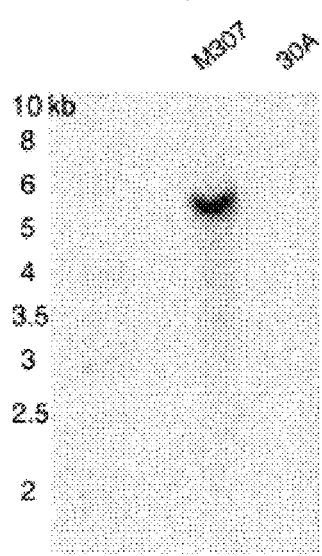
FIGS. 32A-E depict Southern blot analysis showing the generation of the quintuple protease deletion strain M369, clone 7-30A=M369.
Figure 32B:
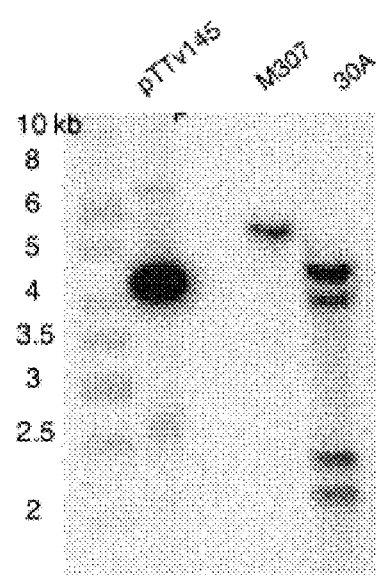
Figure 32C:
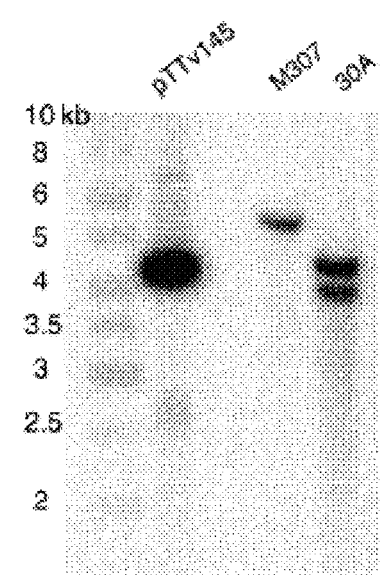
Figure 32D:
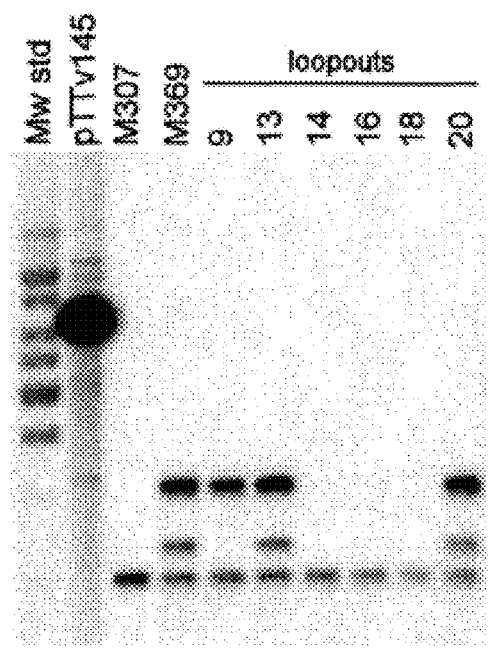
Figure 32E:
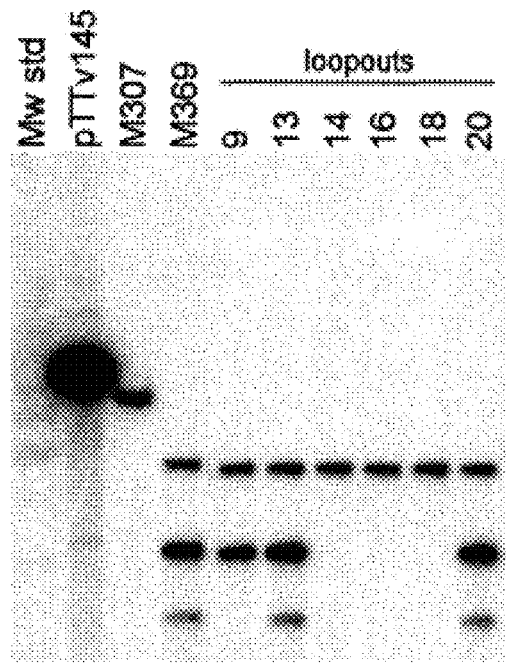

100 clones were picked as first streaks. All 20 growing streaks were screened by PCR using the primers listed in Table 4.3 for the correct integration using standard laboratory methods. 10 putative quintuple protease disruptants (Δpep1 Δtsp1Δslp1Δgap1Δgap2) were purified to single cell clones and rescreened by PCR. Only one purified clone was negative for the gap2 ORF. The gap2 deletion was verified by Southern analyses of the clone (FIG. 32A). Southern analyses were performed as described in Example 1. Southern analyses also indicated the clone carries an additional copy of the deletion cassette somewhere else in the genome or has some internal rearrangements in that locus (FIGS. 32B and 32C). Since this was the only quintuple protease deletion clone obtained it was selected for further use (FIGS. 32D and 32E). Clone 14 was the clone used for removal of the pyr4 blaster cassette, and to generate the 6-fold protease deletion strains M396 and M400 below (FIG. 32E). This clone was designated with strain number M369 (Δpep1 Δtsp1Δslp1Δgap1Δgap2).

TABLE 4.3

Primers for screening removal of pyri blaster cassette and for screening gap2 integration and strain purity.

| Primer | Sequence |
|---|---|
| For screening removal of pyr4 blaster cassette from M307 | |
| T052_gap1_5screen_F | CTCAGAAAGGTTGTAGTTGTGA (SEQ ID NO: 359) |
| T026_Pyr4_orf_5rev2 | CCATGAGCTTGAACAGGTAA (SEQ ID NO: 360) |
| T053_gap1_3screen_R | GATGTTGTGTTTTCAGTCTGCA (SEQ ID NO: 361) |
| T028_Pyr4_flank_rev | CATCCTCAAGGCCTCAGAC (SEQ ID NO: 362) |

TABLE 4.3-continued

Primers for screening removal of pyri blaster cassette and for screening gap2 integration and strain purity.

| Primer | Sequence |
|---|---|
| For screening integration of pTTv145 | |
| T048_gap2_5screen_F | GCTTGGCATCACGGAAGCT (SEQ ID NO: 363) |
| T026_Pyr4_orf_5rev2 | CCATGAGCTTGAACAGGTAA (SEQ ID NO: 364) |
| T049_gap2_3 screen_R | TTGACAAGAAAGGTCCGGTTG (SEQ ID NO: 365) |
| T028_Pyr4_flank_rev | CATCCTCAAGGCCTCAGAC (SEQ ID NO: 366) |
| For screening deletion of gap2 ORF | |
| T107_gap2_ORF_F | ATGGATGCTATCCGAGCCAG (SEQ ID NO: 367) |
| T108_gap2_ORF_R | CTATTCATACTCAACAGTCACA (SEQ ID NO: 368) |

Analysis of Quintuple Protease Deletion Strain

Figure 33:
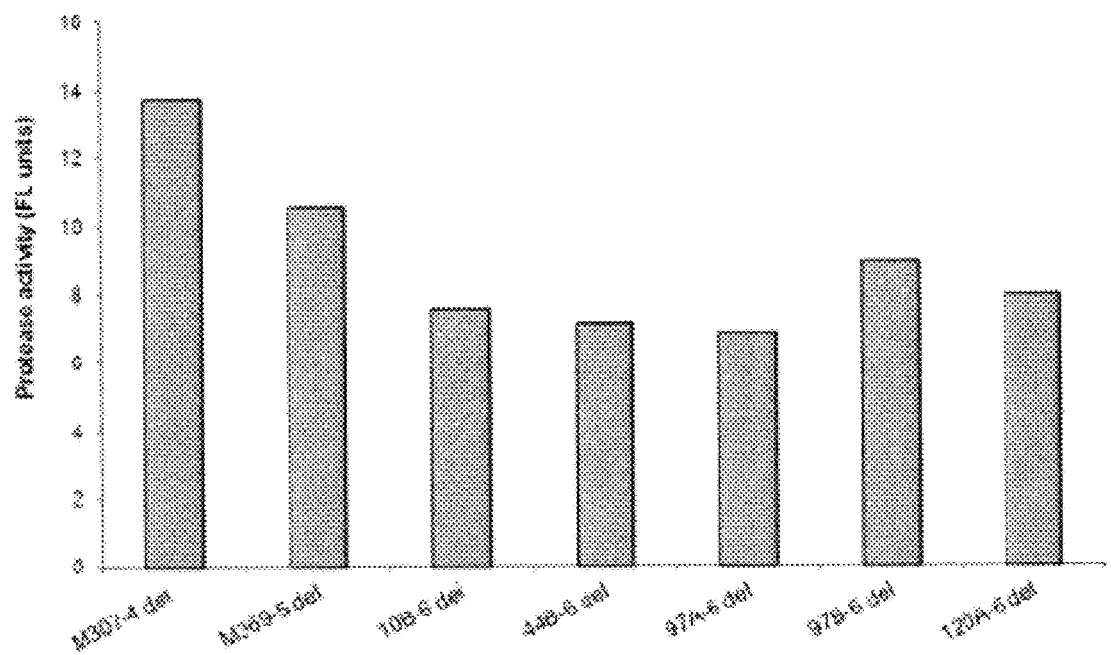
FIG. 33 graphically depicts the protease activity of day 5 supernatants taken from shake flask cultures done with the 4 protease deletion strain M307, the 5 protease deletion strain M369, and the 6 protease deletion transformants 10B, 44B, 97A, 97B, and 120A. Fluorescent casein was incubated with the diluted supernatants in citrate buffer pH 4.5 to detect protease activity.

Protease activity from the M369 strain was measured against its parent strain M307. The gap2 protease deletion resulted in 23% less protease activity against casein (FIG. 33).

6-Fold Deletion Strain

The 6-fold protease deletion strain having deletions Δpep1Δtsp1Δslp1Δgap1Δgap2Δpep4 was generated and used for further rounds of protease deletions.

Generation of Pep4 Deletion Plasmids

The deletion plasmid pTTv181 for the sixth protease gene, aspartic protease pep4 (TreID77579) was constructed essentially as described for the Δpep1 plasmid pTTv71 in Example 1. 959 bp of 5' flanking region and 992 bp of 3' flanking region were selected as the basis of the pep4 deletion plasmid. As for pep1, the first deletion plasmid for pep4 (pTTv43, Table 4.4) carried another selection marker, bar, which was replaced with the pyr4 blaster cassette. The blaster cassette was obtained from pTTv71 with NotI digestion, ligated to NotI cut pTTv43, and then transformed into E. coli using standard methods. A few transformants were cultivated, plasmid DNA isolated and digested to screen for correct ligation and orientation of the pyr4 blaster cassette using standard laboratory methods. One clone with correct insert size and orientation was sequenced and stored (pTTv73, Table 4.4). The blaster cassette was changed slightly once more: the direct repeat fragment used in removal of pyr4 was changed from 308 bp of pyr4 5'UTR to 300 bp direct repeat from the end of pep4 5' flanking region (as in pTTv145, gap2-pyr4). This was made by removing the existing pyr4 blaster cassette from pTTv73 with NotI digestion. The pyr4 gene was amplified by PCR using pTTv73 as a template using the primers in Table 4.4. For the yeast homologous recombination system used in cloning, overlapping sequences for the vector were placed to the appropriate PCR-primers. To enable marker switch in the construct, NotI restriction sites were introduced on both sides of the pyr4 selection marker and for additional cloning steps an AscI site was introduced between the pep4 5' direct repeat and 3' flank. This type of blaster cassette should not leave any additional sequence to the locus of the deleted gene after excision. The 300 bp pep4 5' direct repeat was amplified by PCR using the *T. reesei* wild type strain QM6a as a template. Products were separated with agarose gel electrophoresis and the correct fragments were isolated from the gel with gel extraction kit (Qiagen) using standard laboratory methods. A few of the clones obtained from the recombination were cultivated, and plasmid DNA was isolated and digested to screen for correct recombination using standard methods. These deletion plasmids for pep4 (pTTv43, pTTv73 and pTTv181, Table 4.4) result in a 1413 bp deletion in the pep4 locus and cover the complete coding sequence of PEP4.

TABLE 4.4

Primers for generatin pep4 deletion plasmids.

| Primer | Sequence |
|---|---|
| Deletion plasmid pTTv43 for pep4 (TreID77579), vector backbone pRS426 | |
| T298_77579_5f | GTAACGCCAGGGTTTTCCCAGTCACGACGGTTT AAACTCAGGTCAACCACCGAGGAC (SEQ ID NO: 369) |
| T299_77579_5r_pt | CCCGTCACCGAGATCTGATCCGTCACCGGGATC CACTTAAGCGGCCGCTGAATGGGATGGTTCGAT TG (SEQ ID NO: 370) |
| T300_77579_3f_pt | GCCAAGCCCAAAAAGTGCTCCTTCAATATCATC TTCTGTCGCGGCCGCAGGTAGACGCTTTGCGAG TG (SEQ ID NO: 371) |
| T301_77579_3r | GCGGATAACAATTTCACACAGGAAACAGCGTTT AAACTGAACTGACGCGGACTGA (SEQ ID NO: 372) |
| Deletion plasmid pTTv73 for pep4 (TreID77579), vector backbone pTTv43 | |
| no new primers, pTTv43 digesed with NotI and ligated with pyr4-loopout fragment from pTTv71 | |
| Deletion plasmid pTTv181 for pep4 (TreID77579), vector backbone pTTv73 | |
| T209_pyr4_f_recpep4_5f | AAGTTCCCTTCCTCTGGCAGCAATCGAACCATC CCATTCAGCGGCCGCCTAGCATCGACTACTGCT GC (SEQ ID NO: 373) |
| T210_pyr4_r | CATGCAAAGATACACATCAA (SEQ ID NO: 374) |
| T211_pep4_loop_f_recpyr4 | TGATTGTACCCCAGCTGCGATTGATGTGTATCT TTGCATGGCGGCCGCTCAATGTTGACTGCCCCA GG (SEQ ID NO: 375) |
| T212_pep4_loop_r_recpep4_3 f | GCACTTCTTAGATACACACACACTCGCAAAGCG TCTACCTGGCGCGCCTGAATGGGATGGTTCGAT TG (SEQ ID NO: 376) |

Generation of 6-Fold Protease Deletion Strains M396 and M400

To generate a marker-free 6-fold protease deletion strain, removal of the pyr4 marker was applied to strain M369 essentially as described in Example 3 for removal of pyr4 blaster cassette from the strain M195 (Δpep1). Three consecutive 5-FOA selection steps were carried out to ensure that the clones selected were originating from single cells. Final clones were verified by PCR using the primers listed in Table 4.5 with standard laboratory methods. Signal corresponding to successful removal of the blaster cassette was obtained for all clones. Removal was further verified by plating the clones onto minimal medium plates with or without 5 mM uridine. No growth was observed on the plates without uridine supplementation. Southern analyses of six putative pyr4⁻ clones verified the removal of the blaster cassette for three clones. In addition, the Southern analyses revealed that these three clones have lost the extra signals seen for the gap2 flanks in parent M369. Therefore these clones should have the expected genomic organisation in the gap2 locus. The clone used to generate the 6-fold protease deletion strain was designated with strain number M381 (Δpep1 Δtsp1Δslp1Δgap1Δgap2, pyr4⁻).

To remove vector sequence, plasmid pTTv181 (Δpep4-pyr4 loopout) was digested with PmeI and the correct fragment purified from an agarose gel using QIAquick Gel Extraction Kit (Qiagen). Approximately 5 μg of the pep4 deletion cassette was used to transform M381 (Δpep1 Δtsp1Δslp1Δgap1Δgap2, pyr4⁻). Preparation of protoplasts and transformation were carried out essentially as described in Example 1 for the strains M181 and M195 using pyr4 selection.

Figure 34A:
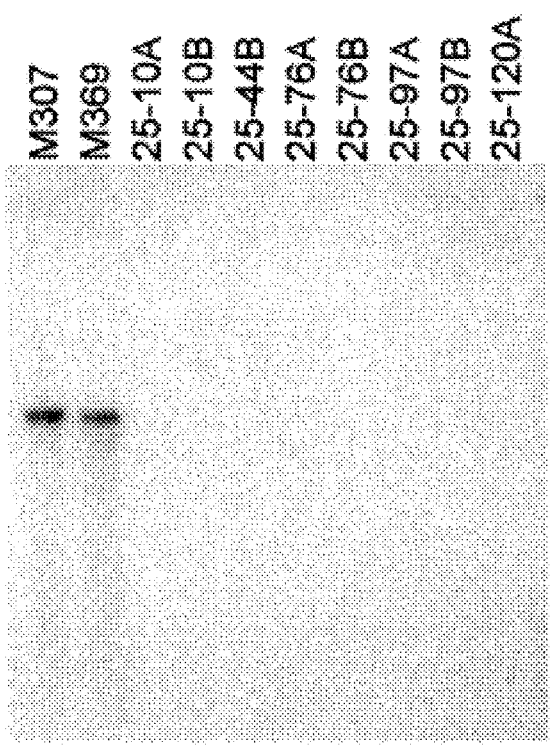
FIGS. 34A-E depict Southern blot analysis showing the generation of the 6-fold protease deletion strains M396 and M400. M396=25-120A. M400=25-120A-a, i.e. repurified clone from M396.
Figure 34B:
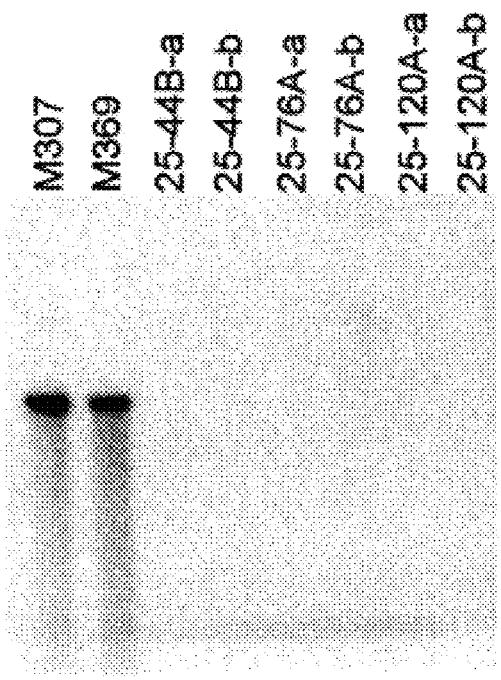
Figure 34C:
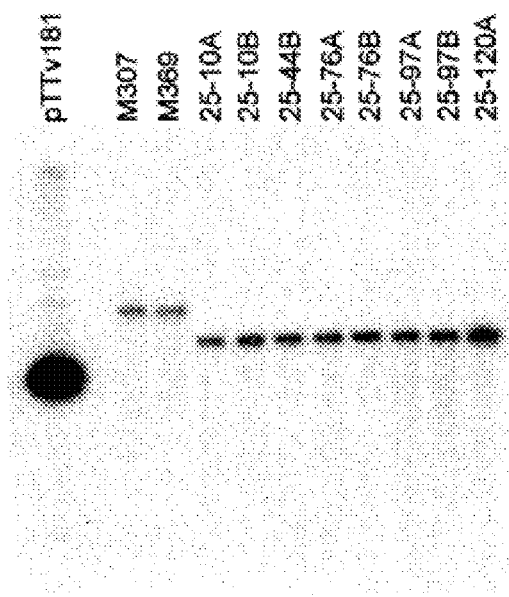
Figure 34D:
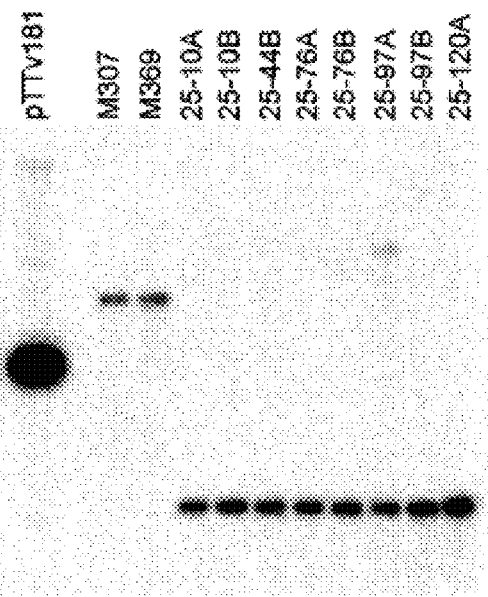

Over 200 transformants were picked as first streaks. 32 growing streaks were screened by PCR (using the primers listed in Table 4.5) for correct integration. Seven clones gave the expected signals and were purified to single cell clones and rescreened by PCR using the primers listed in Table 4.5. Deletion of pep4 was verified by Southern analyses from five clones (FIGS. 34A and 34B) using standard laboratory methods described in Example 3 for M181 and M195. Southern analyses also indicated that all transformants (FIGS. 34C and 34D) were single integrants. To exclude that the faint signal seen in the PCR screening for the pep4 ORF in transformants would originate from pep4 gene, three clones were purified further via single cell steps and reanalysed by Southern hybridisations and PCR. No signal for pep4 ORF was obtained from either analysis indicating strain purity. Clone 25-120A used for removal of the pyr4 blaster cassette (and in generation of the 7-fold protease deletion strain) was designated with strain number M396 and the repurified clone 25-120A-a with strain number M400.

TABLE 4.5

Primers for screening removal of pyr4 blaster cassette from M369 and for screening pep4 integration and strain purity.

| Primer | Sequence |
|---|---|
| For screening removal of pyr4 blaster cassette from M369 | |
| T222_gap2_5f_f2 | GGCAGGTCGCAGAGCAAGACA (SEQ ID NO: 377) |
| T049_gap2_3_screen_R | TTGACAAGAAAGGTCCGGTTG (SEQ ID NO: 378) |
| For screening integration of pTTv181 | |
| T302_77579_5int | GATTCATCACAGGGGCAGTC (SEQ ID NO: 379) |
| T027_Pyr4_orf_start_rev | TGCGTCGCCGTCTCGCTCCT (SEQ ID NO: 380) |
| T415_77579_3screen | ACGCCGTTGCTGAGCCTTG (SEQ ID NO: 381) |
| T061_pyr4_orf_screen_2F | TTAGGCGACCTCTTTTTCCA (SEQ ID NO: 382) |

Analysis of Protease Activity in the 4-, 5-, and 6-Fold Protease Deletion Strains The quadruple protease deletion strain M307, the quintuple protease deletion strain M369, and the 6-fold protease deletion strain transformants were cultivated in shake flask cultures. Supernatant samples taken from large shake flask cultures grown in TrMM with 20 g/L spent grain and 40 g/L lactose buffered with 100 mM PIPPS at pH 4.8. The pH was ~4.25 on day 5. The 6 protease deletion transformants tested were not the final strain, so there was some variation due to the purity of the spores. These were some of the best transformants, but further spore purification was done subsequently. The day 5 supernatants were diluted 1:3 in 50 mM sodium citrate buffer pH 4.5. To this diluted supernatant BODIPY casein FL (10 μg ml) was added and incubated together at 37° C. for 4 hours. To protease activity assay was conducted as described in the manufacture's protocol (enzCheck protease assay kit #E6638, Molecular Probes). The protease activity results can be seen in FIG. 33.

There was a small reduction in protease activity when the quintuple protease deletion strain M369 was grown under acidic conditions. The deletion of gap2 in the strain provided a 23% reduction in protease activity against casein. In the 6-fold protease deletion strains the aspartic protease pep4 was deleted in the 5 transformants studied. The best transformant showed a 35% reduction compared to its parent strain M369.

Generation of 7-Fold Deletion Strain

The 7-fold protease deletion strain having deletions Δpep1 Δtsp1Δslp1Δgap1Δgap2Δpep4Δpep3 was generated and used for further rounds of protease deletions.

Generation of Pep3 Deletion Plasmids

The first deletion plasmid pTTv188 for the seventh protease gene, aspartic protease pep3 (TreID121133) was constructed essentially as described for Δpep1 plasmid pTTv41 in Example 1. 1215 bp of 5' flanking region and 1082 bp of 3' flanking region were selected as the basis of the pep3 deletion plasmid. As for gap2 (pTTv145) and pep4 (pTTv181) deletion plasmids above, in this plasmid the direct repeat fragment is a 300 bp stretch from the end of pep3 5' flanking region. Fragments were produced by PCR using the primers listed in Table 4.6. As for pTTv181 (Δpep4-pyr4) above, to enable marker switch in the construct, NotI restriction sites were introduced on both sides of the pyr4 selection marker and for additional cloning steps an AscI site was introduced between the pep3 5'direct repeat and 3' flank. The products were separated with agarose gel electrophoresis and the correct fragments were isolated from the gel with gel extraction kit (Qiagen) using standard laboratory methods. Template used in the PCR of the flanking regions was the *T. reesei* wild type strain QM6a. The pyr4 marker gene was obtained from pTTv181 with NotI digestion. The vector backbone was EcoRI/XhoI digested pRS426 as in Example 1. The plasmid was constructed using the yeast homologous recombination method described in Example 1.

The second deletion plasmid for the aspartic protease pep3 (TreID121133), pTTv192, was constructed using the plasmid pTTv188 above as the backbone. This second plasmid carries a native KEX2 (TreID123156) overexpression cassette and uses acetamidase (AmdS) gene from *Aspergillus nidulans* as the selection marker. The pyr4 blaster cassette was removed from pTTv188 with NotI-AscI double digestion. The fragments for cDNA1 promoter (template: pTHN3 plasmid DNA), native kex2 (template: *T. reesei* QM6a genomic DNA), trpC terminator (template: pHH02 plasmid DNA) and AmdS marker (template: pHH01 plasmid DNA) were produced by PCR using the primers listed in Table 4.6. As for pTTv188 above, to enable marker switch in the construct, NotI restriction sites were introduced on both sides of the AmdS selection marker. The products were separated with agarose gel electrophoresis and the correct fragments were isolated from the gel with gel extraction kit (Qiagen) using standard laboratory methods. The plasmid was constructed using the yeast homologous recombination method described in Example 1.

The third deletion plasmid for the aspartic protease pep3 (TreID121133), pTTv205, was constructed using the plasmid pTTv192 above as the backbone. The AmdS marker was removed from pTTv192 with NotI digestion. Fragments for a new pyr4 blaster cassette (located after the KEX2 overexpression cassette) were produced by PCR using the primers listed in Table 4.6. In this blaster cassette, the direct repeat is a 300 bp stretch from the beginning of the pep3 3' flanking region and located before the pyr4 gene. As for pTTv192 above, to enable marker switch in the construct, NotI restriction sites were introduced on both sides of the pyr4 blaster cassette. The products were separated with agarose gel electrophoresis and the correct fragments were isolated from the gel with gel extraction kit (Qiagen) using standard laboratory methods. The plasmid was constructed using the yeast homologous recombination method described in Example 1.

These deletion plasmids for pep3 (pTTv188, pTTv192 and pTTv205, Table 4.6) result in a 2590 bp deletion in the pep3 locus and cover the complete coding sequence of PEP3.

TABLE 4.6

Primers for generatin pep3 deletion plasmids.

| Primer | Sequence |
| --- | --- |
| Deletion plasmid pTTv188 for pep3 (TreID121133), vector backbone pRS426 | |
| T346_pep3_5f_for | GGTAACGCCAGGGTTTTCCCAGTCACGACGGTTT AAACGTCGAGCCCCCTGGACACCT (SEQ ID NO: 385) |
| T347_pep3_5f_rev | GCGCTGGCAACGAGAGCAGAGCAGCAGTAGTCGA TCCTAGGCGGCCGCCATCGCCGTCGCGGACATGA (SEQ ID NO: 386) |
| T348_pep3_loop_for | TGATTGTACCCCAGCTGCGATTGATGTGTATCTT TGCATGGCGGCCGCTCGACGTTGTATCTGCACTC (SEQ ID NO: 387) |
| T349_pep3_loop_rev | GTACGTTCTGATTGCCAACTACGGACCAGACCAG GGCTCCGGCGCGCCCATCGCCGTCGCGGACATGA (SEQ ID NO: 388) |
| T350_pep3_3f_for | GGAGCCCTGGTCTGGTCCGT (SEQ ID NO: 389) |
| T351_pep3_3f_rev | AGCGGATAACAATTTCACACAGGAAACAGCGTTT AAACACGCGCTTCAACATGCCCCA (SEQ ID NO: 390) |
| Deletion plasmid pTTv192 for pep3 (TreID121133), vector backbone pTTv188 | |
| T389_cDNApromoter_pep3flank | GCTGGCCGCTGGGAATAGCGTCATGTCCGCGACG GCGATGGAATTCGGTCTGAAGGACGT (SEQ ID NO: 391) |
| T138_cDNA1_Rev | GTTGAGAGAAGTTGTTGGATTG (SEQ ID NO: 392) |

TABLE 4.6-continued

Primers for generatin pep3 deletion plasmids.

| Primer | Sequence |
|---|---|
| T139_123561For_cDNA1 | AACCAAAGACTTTTTGATCAATCCAACAACTTCT CTCAACATGAAGATTTCCTCGATCCTTG (SEQ ID NO: 393) |
| 123561Rev | TCAGCGCCGTAACCTCTGC (SEQ ID NO: 394) |
| trpCtermFor_123561 | TGATGGTGATGAGGCGGAAAAGCAGAGGTTACGG CGCTGAGGATCCACTTAACGTTACTGA (SEQ ID NO: 395) |
| T390_trpCtermR_AmdS | TCTCTCAAAGGAAGAATCCCTTCAGGGTTGCGTT TCCAGTGCGGCCGCTCTCCTTCTAGAAAGAAGGA TTA (SEQ ID NO: 396) |
| T391_AmdS_endR | ACTGGAAACGCAACCCTGAA (SEQ ID NO: 397) |
| T390_trpCtermR_AmdS | TCTGATTGCCAACTACGGACCAGACCAGGGCTCC GGCGCGGCGGCCGCTAGATCTACG (SEQ ID NO: 398) |

Deletion plasmid pTTv205 for pep3 (TreID121133), vector backbone pTTv192

| T428_pep3_3ilankDR_F-trpCterm | GTACACTTGTTTAGAGGTAATCCTTCTTTCTAGA AGGAGACCGGCCGCGGAGCCCTGGTCTGGTCC (SEQ ID NO: 399) |
| T429_pep3_3ilankDR_R-pyr4 | GCGCTGGCAACGAGAGCAGAGCAGCAGTAGTCGA TGCTAGAAGCTGACGGGCGTCAACG (SEQ ID NO: 400) |
| T094_pyr4_F | TAGCATCGACTACTGCTGC (SEQ ID NO: 401) |
| T430_pyr4_R-pep3_3ilank | GTACGTTCTGATTGCCAACTACGGACCAGACCAG GGCTCCGCGGCCGCCATGCAAAGATACACATCAA TC (SEQ ID NO: 402) |

Generation of 7-Fold Protease Deletion Strains

To generate a marker-free 7-fold protease deletion strain, removal of the pyr4 marker was applied to the 6-fold deletion strain M396 essentially as described in Example 3 for removal of the pyr4 blaster cassette from the strain M195 (Δpep1). Four consecutive 5-FOA selection steps were carried out to ensure that the clones selected were originating from single cells.

Figure 34E:
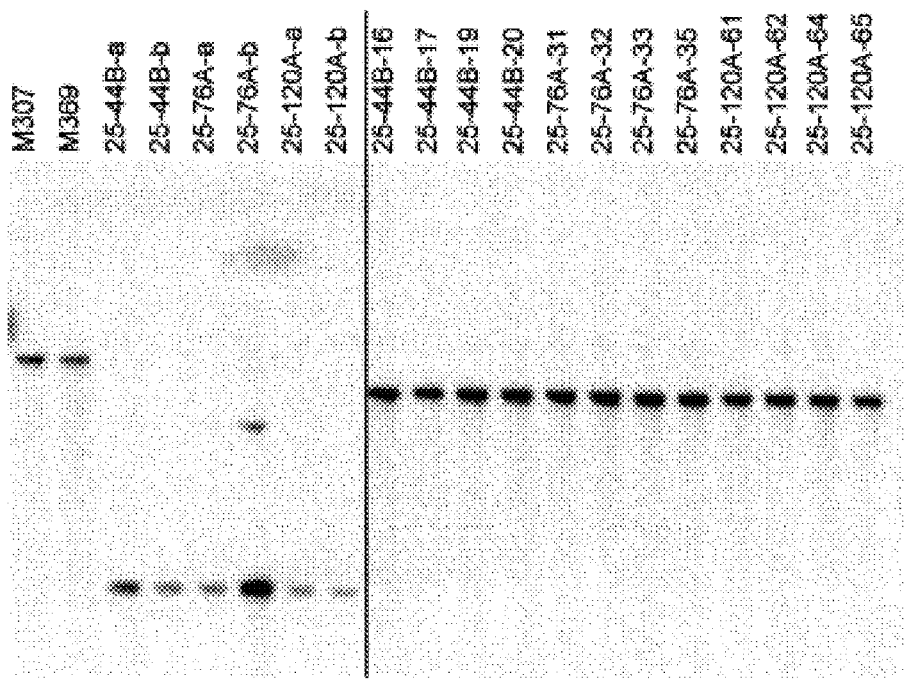

Final clones were verified by PCR using the primers listed in Table 4.7 with standard laboratory methods. Signal corresponding to successful removal of the blaster cassette was obtained. Removal of the blaster cassette was further verified by plating the clones onto minimal medium plates with or without 5 mM uridine. No growth was observed on the plates without uridine supplementation. Southern analyses of four putative pyr4⁻ clones verified the removal of the blaster cassette for all clones (FIG. 34E). The clone (25-120A-62) used to generate the 7-fold protease deletion strain was designated with strain number M402 (Δpep1 Δtsp1Δslp1Δgap1Δgap2Δpep4, pyr4).

Two parallel transformations were carried out; one with the deletion construct from pTTv188 (standard pep3 deletion) and the other with pTTv205 (KEX2 overexpression included). To remove vector sequence, plasmids pTTv188 and pTTv205 were digested with PmeI and the correct fragments purified from agarose gel using QIAquick Gel Extraction Kit (Qiagen). Approximately 5 μg of either deletion cassette was used to transform M402 (Δpep1 Δtsp1Δslp1Δgap1Δgap2Δpep4, pyr4⁻). Preparation of protoplasts and transformation were carried out essentially as described in Example 1 for the strains M181 and M195 using pyr4 selection.

Transformants were picked as first streaks. Growing streaks were screened by PCR (using the primers listed in Table 4.7) for correct integration. Clones giving the expected signals were purified to single cell clones and rescreened by PCR using the primers listed in Table 4.7.

Deletion of pep3 was verified by Southern analyses from selected clones using methods described in Example 1. Chosen clones were used for removal of the pyr4 blaster cassette, and in generation of the 8-fold protease deletion strains (FIG. 34E).

TABLE 4.7

Primers for screening removal of pyr4 blaster cassette from M396 and for screening pep3 integration and strain purity.

| Primer | Sequence |
|---|---|
| For screening removal of pyr4 blaster cassette from M396 | |
| T302_77579_5int | GATTCATCACAGGGGCAGTC (SEQ ID NO: 403) |
| T214_pep4_3f_seq_r1 | CCGCTCTCAAACTGCCCAAA (SEQ ID NO: 404) |
| For screening integration of pTTv188 | |
| T625_pep3_5int_new | ACGTGAAGTTGCCCATCAA (SEQ ID NO: 405) |
| T026_Pyr4_orf_5rev2 | CCATGAGCTTGAACAGGTAA (SEQ ID NO: 406) |
| T626_pep3_5int_new | GACCAATGGCTTCACGAAGT (SEQ ID NO: 407) |
| T061_pyr4_orf_screen_2F | TTAGGCGACCTCTTTTTCCA (SEQ ID NO: 408) |
| For screening integration of pTTv205 | |
| T625_pep3_5int_new | ACGTGAAGTTGCCCATCAA (SEQ ID NO: 409) |
| T140_cDNA 1promoter_seqR1 | TAACTTGTACGCTCTCAGTTCGAG (SEQ ID NO: 410) |
| T626_pep3_3int_new | GACCAATGGCTTCACGAAGT (SEQ ID NO: 411) |
| T061_pyr4_orf_screen_2F | TTAGGCGACCTCTTTTTCCA (SEQ ID NO: 412) |
| For screening deletion of pep3 ORF | |
| T352_pep3_orf_for | CAGCAGCACCGCATCCACCA (SEQ ID NO: 413) |
| T353_pep3_orf_rev | GCCGAATCGCTGGTTGCCCT (SEQ ID NO: 414) |
| T753_pep3_orf_for2 | ATGGAAGCCATCCTCCAGG (SEQ ID NO: 415) |
| T754_pep3_orf_rev2 | TGGATCATGTTGGCGACG (SEQ ID NO: 416) |
| T855_pep3_orf_f3 | GTAAGACGCCCCGTCTC (SEQ ID NO: 417) |

Generation of 8-Fold Deletion Strain

The 8-fold protease deletion strain having deletions Δpep1 Δtsp1Δslp1Δgap1Δgap2Δpep4Δpep3Δpep5 is generated.

Generation of Pep5 Deletion Plasmid

The first deletion plasmid for the eighth protease gene, aspartic protease pep5 (TreID81004) was constructed essentially as described for the Δpep1 plasmid pTTv41 in Example 1, but an additional second selection marker cassette (bar, Example 1) was placed after the pyr4 gene creating a deletion plasmid with a double selection marker blaster cassette. The double marker system enables a) utilisation of e.g. bar (or hph, a cassette for hygromycin resistance) as the initial resistance marker and faster selection; b) transformation of pyr4+ strains (without the need to generate pyr4⁻ prior to transformation); and c) removal of both markers from the transformants using 5-fluoroorotic acid (like in removal of standard pyr4 blaster cassette) and simultaneous mutagenization of the endogenous pyr4 resulting in marker-free, pyr4⁻ strain.

The second deletion plasmid for the aspartic protease pep5 (TreID81004), pTTv229, was constructed using the plasmid pTTv202 above as the backbone. The pyr4-bar double marker was removed from pTTv202 with NotI digestion. The pyr4 marker gene was obtained from pTTv181 with NoiI digestion. Cloning of the plasmid pTTv229 was done with standard ligation using T4 DNA ligase at room temperature. Part of the ligation mixture was transformed into E. coli with electroporation. A few clones were cultivated, plasmid DNA was isolated and digested to screen for correct ligation using standard laboratory methods. Correct ligation and orientation of the marker was further verified by sequencing. These deletion plasmids for pep5 (pTTv202 and pTTv229, Table 4.8) result in a 1687 bp deletion in the pep5 locus and cover the complete coding sequence of PEP5.

1348 bp of 5' flanking region and 1164 bp of 3' flanking region were selected as the basis of the pep5 deletion plasmid. A 300 bp stretch from the end of pep5 5' flank was used as the direct repeat fragment. These fragments as well as the second selection marker cassette, bar (Example 1), were amplified by PCR using the primers listed in Table 4.8. The products were separated with agarose gel electrophoresis and the correct fragments were isolated from the gel with a gel extraction kit (Qiagen) using standard laboratory methods. To enable removal of the complete double marker cassette, NotI restriction sites were introduced on both sides of the double marker cassette, and an AsiSI site between the two selection markers. An AscI site was introduced between the pep5 5'direct repeat and 3' flank. Vector backbone was EcoRI/XhoI digested pRS426 as in Example 1. The pyr4 selection marker was obtained from pTTv181 (Δpep4-pyr above) with NotI digestion. The plasmid was constructed using the yeast homologous recombination method described in Example 1. This deletion plasmid for pep5 (pTTv202, Table 4.8) results in a 1687 bp deletion in the pep5 locus and covers the complete coding sequence of PEP5.

TABLE 4.8

Primers for generatin pep5 deletion plasmid.

| Primer | Sequence |
|---|---|
| Deletion plasmid pTTv202 for pep5 (TreID81004), vector backbone pRS426 | |
| T372_pep5_ 5f_for | GGTAACGCCAGGGTTTTCCCAGTCACGACGGTTT AAACGGAGGCTGCGACACCGTCTG (SEQ ID NO: 418) |

TABLE 4.8-continued

Primers for generatin pep5 deletion plasmid.

| Primer | Sequence |
|---|---|
| T373_pep5_ 5f_rev | GCGCTGGCAACGAGAGCAGAGCAGCAGTAGTCGA TGCTAGGCGGCCGCCCGGCCTGAAACGACCTCCC (SEQ ID NO: 419) |
| T376_pep5_ 5DR_for | CCCGTCACCGAGATCTGATCCGTCACCGGGATCC ACTTAAGCGGCCGCGAGAGAGAAACAAAACAGTG (SEQ ID NO: 420) |
| T377_pep5_ 5DR_rev | ACATTCCGACCGTTTACTGATCCAAGCCGTGCAA CCGACTGGCGCGCCCCGGCCTGAAACGACCTCCC (SEQ ID NO: 421) |
| T378_pep5_ 3f_for | AGTCGGTTGCACGGCTTGGA (SEQ ID NO: 422) |
| T379_pep5_ 3f_rev | AGCGGATAACAATTTCACACAGGAAACAGCGTTT AAACGAGACGGACGCCTGCACCAC (SEQ ID NO: 423) |
| T374_bar_ recpyr4_for2 | TGATTGTACCCCAGCTGCGATTGATGTGTATCTT TGCATGGCGATCGCGACAGAAGATGATATTGAAG (sEq ID NO: 424) |
| T375_bar_rev | TTAAGTGGATCCCGGTGACG (SEQ ID NO: 425) |
| Deletion plasmid pTTv229 for pep5 (TreID81004), vector backbone pTTv202 | |
| no new primers, pTTv202 digested with NotI and ligated with pyr4 fragment from pTTv181 | |

Generation of 8-Fold Protease Deletion Strain

To generate a marker-free 8-fold protease deletion strain, removal of the pyr4 marker was applied to the 7-fold deletion strain M486 (34-14A-a, pTTv205 in M402) essentially as described in Example 3 for removal of the pyr4 blaster cassette from the strain M195 (Δpep1). Four consecutive 5-FOA selection steps were carried out to ensure that the clones selected were originating from single cells.

Final clones were verified by PCR using the primers listed in Table 4.9 with standard laboratory methods. Signal corresponding to successful removal of the blaster cassette was obtained for majority of the clones. Removal of the blaster cassette was further verified by plating the clones onto minimal medium plates with or without 5 mM uridine. No growth was observed on the plates without uridine supplementation. Southern analyses of putative pyr4⁻ clones verified the removal of the blaster cassette.

To remove vector sequence, plasmid pTTv229 was digested with PmeI+XbaI and the correct fragment purified from an agarose gel using a QIAquick Gel Extraction Kit (Qiagen). Approximately 5 μg of the deletion cassette was used to transform a clone of 8-fold protease deletion strain (Δpep1 Δtsp1Δslp1Δgap1Δgap2Δpep4Δpep3, pyr4⁻). Preparation of protoplasts and transformation were carried out essentially as described in Example 1 for the strains M181 and M195 using pyr4 selection.

Transformants were picked as first streaks. Growing streaks are screened by PCR (using the primers listed in Table 4.9) for correct integration. Clones giving the expected signals are purified to single cell clones and rescreened by PCR using the primers listed in Table 4.9. Deletion of pep5 is verified by Southern analyses from selected clones using methods described in Example 1.

TABLE 4.9

Primers for screening removal of pyr4 blaster cassette from 7-fold strain and for screening pep5 integration and strain purity.

| Primer | Sequence |
|---|---|
| For screening removal of pyr4 blaster cassette from M486 and strain purity | |
| T047_trpC_term_end_F | CCTATGAGTCGTTTACCCAGA (SEQ ID NO: 426) |
| T854_pep3_3f_r2 | TGGCCGAGTCTATGCGTA (SEQ ID NO: 427) |
| T488_pyr4_5utr_rev | GGAGTTGCTTTAATGTCGGG (SEQ ID NO: 428) |
| T061_pyr4_orf_screen_2F | TTAGGCGACCTCTTTTTCCA (SEQ ID NO: 429) |
| T855_pep3_orf_f3 | GTAAGACGCCCCGTCTC (SEQ ID NO: 430) |
| T754_pep3_orf_rev2 | TGGATCATGTTGGCGACG (SEQ ID NO: 431) |
| For screening integration of pTTv229 | |
| T627_pep5_5int_new | GTCGAAGATGTCCTCGAGAT (SEQ ID NO: 432) |
| T488_pyr4_5utr_rev | GGAGTTGCTTTAATGTCGGG (SEQ ID NO: 433) |
| T061_pyr4_orf_screen_2F | TTAGGCGACCTCTTTTTCCA (SEQ ID NO: 434) |
| T628_pep5_3int_new | TAGTCCATGCCGAACTGC (SEQ ID NO: 435) |
| For screening deletion of pep5 ORF | |
| T418_pep5_orf_for | CCGGACCTGCACCGCAAGTT (SEQ ID NO: 436) |
| T419_pep5_orf_rev | AGGGCAATGTCGCCCAGCAC (SEQ ID NO: 437) |
| T859_pep5_orf_f2 | GACCTGCACCGCAAGTT (SEQ ID NO: 438) |
| T860_pep5_orf_f3 | GTCGAGCGTCTGATATTCAC (SEQ ID NO: 439) |
| T861_pep5_orf_r2 | GACGGAGACCTCCCACA (SEQ ID NO: 440) |

Example 5—Improved Antibody Production with Protease Inhibitors

This example demonstrates the ability of protease inhibitors to increase full length antibody production in *Trichoderma reesei* production strains.

Based on the knowledge that the heavy chain is cleaved by tryptic and chymotryptic proteases, inhibitors of these two enzyme classes were tested against antibody degradation both in vitro and in culture experiments utilizing an antibody producing *T. reesei* strain. The inhibitors soybean trypsin inhibitor (SBTI) and chymostatin were tested, as they have been previously shown in in vitro experiments to stabilize antibody heavy chains.

In Vitro Inhibitor Treatment

Chymostatin and SBTI were analyzed in vitro with culture supernatant. Supernatant from a fed batch fermentor culture was diluted to 6 mg/ml with sodium citrate buffer pH 5.5 (pH 5,5; 28° C.; 20 g/L spent grain extract, 60 g/L lactose). The fedbatch cultivation was performed with the *T. reesei* wild type strain M44, which does not contain heterologous protein expression. The strain was grown in *Trichoderma* minimal medium supplemented with 20 g/l spent grain extract and 60 g/l lactose at pH 5.5 and 28° C.

Figure 35:
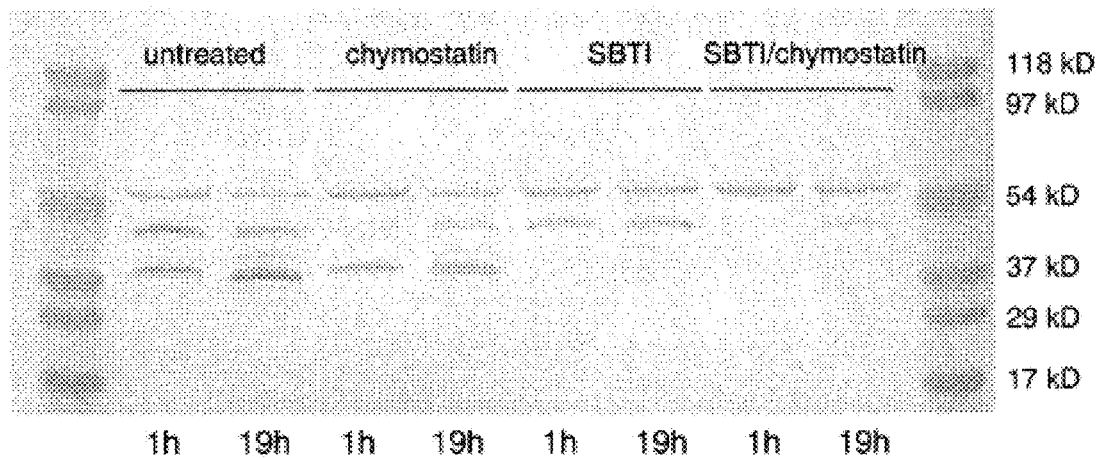
FIG. 35 depicts an immunoblot showing the amount of rituximab heavy chain fragments created in vitro by supernatant proteases.

To this diluted supernatant 0.05 μg μl of rituximab, 100 μM chymostatin, 1 mg/ml SBTI, or a combination of both inhibitors was added in a total volume of 50 μl and sampled at 0, 1, and 19 hours to assess the early and late degradation of the rituximab antibody heavy chain. The resulting heavy chain products were analyzed by immunoblot using and anti-heavy chain AP conjugated antibody (Sigma #A3188) diluted 1:30,000 in TBST (FIG. 35). The initial degradation products generated from the heavy chain were approximately 42 kDa and 38 kDa, which were seen in the untreated control lane at 1 hour (FIG. 35). Additional fragments were generated after 19 hours, the two major products remained. Chymostatin treatment inhibited the initial production of the 42 kDa fragment, while SBTI treatment inhibited the 38 kD fragment from forming (FIG. 35). Combining the two compounds inhibited about 96% of the initial heavy chain degradation and about 75% of the degradation after 19 hours (FIG. 35). These results demonstrate that the two inhibitors were able to effectively stabilize the rituximab antibody heavy chain.

Treatment of *T. reesei* Cultures with Inhibitors

The effectiveness of the inhibitors was also tested with the rituximab antibody producing strain, which contains a VALEKR linker sequence and the pep1 deletion. This strain was grown in triplicate, in small flasks both in presence or absence of chymostatin, SBTI, or pepstatin A. The small shake flasks contained 50 ml of TrMM plus lactose (40 g/1), spent grain extract (20 g/1), and buffer with 100 mM PIPPS at pH 5.5. The SBTI inhibitor was added to the culture at final concentrations of either 100 μg/ml or 500 μg/ml. Chymostatin was used at 100 μM, and pepstatin A was used at 10 μM. Each of the three inhibitors was added to the cultures daily on day 2, 3, 4, and 5.

Growth of the cultures was followed daily by pH from day 2 until day 7. For the cultures grown with SBTI there were no significant differences in the pH of the cultures compared to the untreated controls. In the PIPPS buffered cultures, the pH decreased from an initial pH of 5.5 down to a pH of 4.8 after day 6. With chymostatin and pepstatin A the cultures were monitored up to day 7. On day 7 the average pH for the control bottles was 4.6, while the average pH for chymostatin treated cultures was 4.9, and the average pH of pepstatin A treated cultures was 5.0. Thus, for the cultures treated with chymostatin and pepstatin A there was a small reduction in growth.

Culture supernatant samples (30 μl) were also collected on days 3, 4, and 5 for analysis of antibody production. The analysis was performed by immunoblots using an anti-IgG heavy chain antibody AP conjugate (Sigma #A3188) and an anti-light chain antibody AP conjugate (Sigma #A3812). Each antibody was diluted 1:30,000 in TBST. The full length rituximab heavy chain is about 51 kD, the rituximab light chain CHBI fusion is about 100 kD, and the free rituximab light chain is about 28 kD.

Figure 36A:
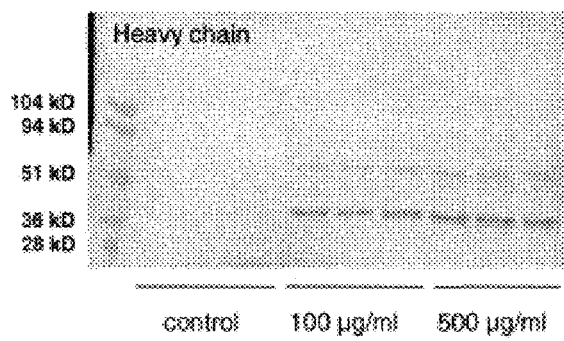
FIGS. 36A-B depict an immunoblot showing degradation of heavy chain and light chain by supernatant samples from SBTI treated cultures and untreated controls.
Figure 36B:
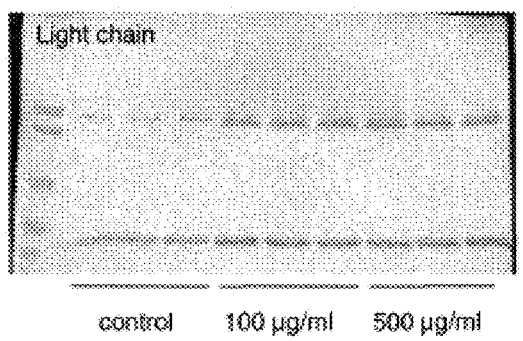

Results of immunoblot analysis of culture supernatant samples treated with SBTI are shown in FIG. 36. On all days sampled there was more full length rituximab heavy chain and more 38 kD degradation product present in the SBTI treated cultures than in untreated cultures. On day 5 rituximab heavy chain production was several fold higher in the SBTI treated cultures than in untreated cultures (FIG. 36A). Thus, the use of SBTI had a positive effect on improving rituximab heavy chain production. There was also a minor improvement in overall rituximab light chain production, particularly with the carrier bound light chain (FIG. 36B).

Figure 37A:
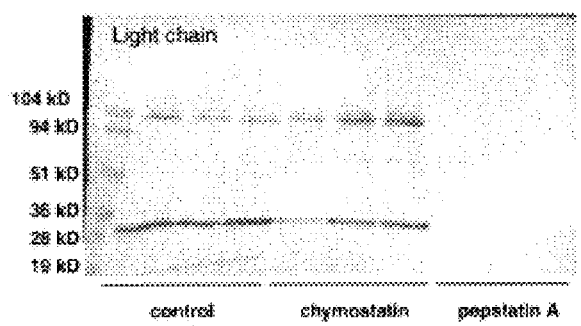
FIGS. 37A-B depict an immunoblot showing the level of degradation of heavy chain and light chain by supernatant samples from cultures treated with chymostatin and pepstatin A, or from untreated control cultures.
Figure 37B:
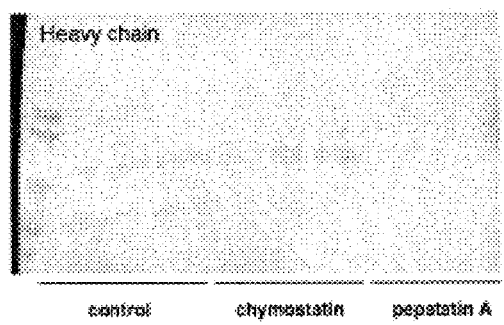

Results of immunoblot analysis of culture supernatant samples treated with chymostatin and pepstatin A are shown in FIG. 37. Chymostatin treated cultures showed similar results as those seen with SBTI (FIG. 37). The rituximab heavy chain was stabilized on day 5 (FIG. 37B). When compared to the untreated control cultures, chymostatin increased the amount of full length rituximab heavy chain produced, although there the major degradation product at 38 kD was still seen.

Overall, it appears that SBTI treatment was more effective in promoting higher protein production than chymostatin treatment. However, chymostatin treatment produced a higher full length rituximab heavy chain to fragment ratio. As seen in FIG. 37B, the third chymostatin culture sample showed approximately 90% full length rituximab heavy chain compared to 10% heavy chain fragment. Thus, the combination of SBTI and chymostatin treatment would be very beneficial to achieving higher antibody production yields.

Example 6—*T. reesei* Antibody Production

This example quantifies the amount of antibodies produced in the *T. reesei* protease deletion strains described above in Examples 1-4.

Antibody Purification

Culture supernatants from each of the *T. reesei* protease deletion strains listed in Table 6.1 were filtered through 0.45 µm syringe filter and adjusted to the composition of binding buffer by adding 1/50 volume of 1 M sodium phosphate, pH 7, prior to purification. The affinity column was connected to an AKTA Purifier, and the purification was performed according to the manufacturer's instructions. The following chromatography conditions were used: flow rate, 1 ml/min; detection 280 nm; injection loop, 5 ml; buffer A, 20 mM sodium phosphate, pH 7; buffer B, 0.1 M glycine-HCl, pH 2.7. Isocratic run with buffer A was conducted until the start of the elution, which was carried out with 5 ml of buffer B. The column was equilibrated at least with 5 ml of buffer A prior to each analysis. 1 ml of culture supernatant was injected for quantitative runs. 0.5 ml fractions were collected into tubes containing 40 µl of 0.5 M Tris, pH 9, during the elution step. Antibody was eluted sharply in two fractions, which were pooled into one sample of 1 ml. From the samples with the highest peak areas among each sample series (fermentation), one run with 5-10 ml injection volume was performed to obtain more concentrated sample for gel filtration analysis.

For quantification, a series of dilutions was prepared of antibody standard and run in 1 ml volume in HiTrap Protein G column similarly to the samples analyzed. A standard curve (10-500 µg) was established of the peak areas measured at 280 nm and used for the quantification of the MAB01 or rituximab antibodies isolated from the culture supernatants. The quality of the purified samples was checked by SDS-PAGE.

Gel Filtration Profiles of Prot G Purified Samples

Figure 38:
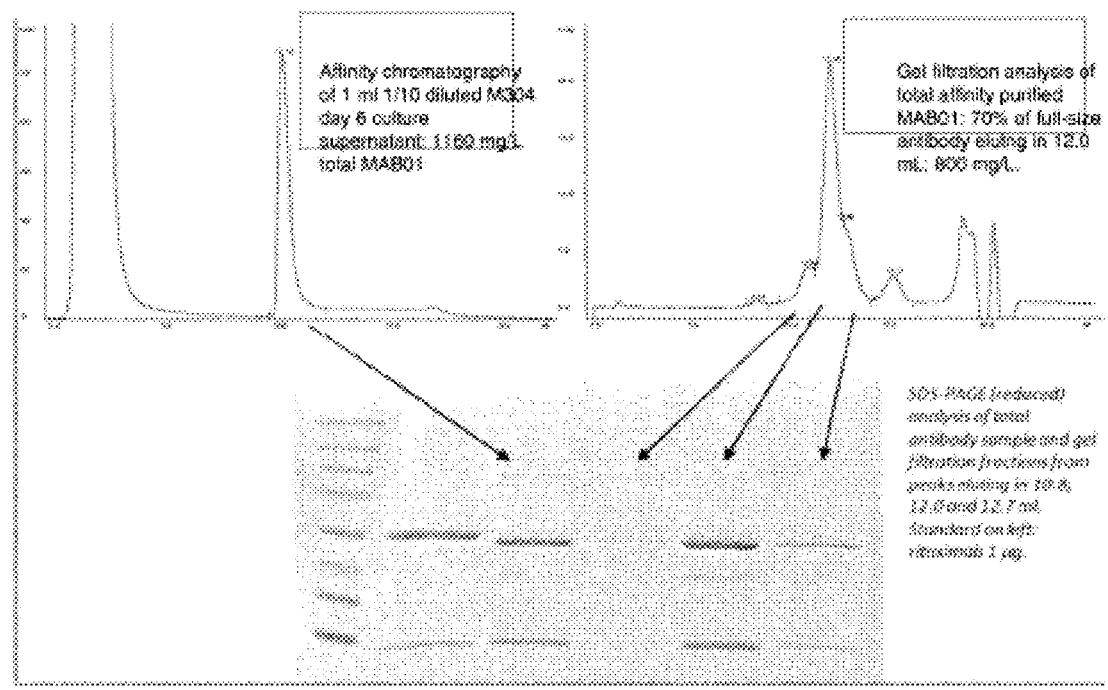
FIG. 38 depicts the process of purifying antibodies from *T. reesei* culture supernatants.

A 250 µl sample of each purified MAB01 and rituximab antibody was run in Tris-buffered saline (25 mM Tris, 140 mM NaCl, and 3 mM KCl, pH7.4) in a Superdex 200 10/300 GL gel filtration column (Amersham Biosciences) connected to an AKTA Purifier HPLC system. The flow rate was 0.75 ml/min and absorbance was measured at 280 nm. Fractions (0.75 ml) were collected during the whole run. The fractions showing only one peak were concentrated and characterized on a standard SDS-PAGE gel (FIG. 38). The percentage of each peak eluted was calculated by dividing the peak area with the total area of the sample measured at 280 nm.

The antibody purification process is shown in FIG. 38.

Antibody Quantification

The amounts of antibodies produced by the *T. reesei* protease deletion strains are summarized in Table 6.1.

TABLE 6.1

Summary of quantity and quality of antibodies produced by crude fermentor supernatant cultures from *T. reesei* strains described in Examples.

| Heterologous protein | Aprotease | Culture | Total amount of niAb (mg/L) | Total amount of full length mAb (mg/L) | Notes/Conditions |
|---|---|---|---|---|---|
| MAB02 | none | shake flask | 3 | n/a | |
| Rituximab | none | shake flask | 9 | n/a | |
| Rituximab | none | fermentation | 21 | n/a | strain M187; pH 5.5; 28° C.; 9 g/l casaminoacids; 20 g/L spent grain extract, 60 g/L lactose |

| Heterologous protein | Δprotease | Culture | Total amount of mAb (mg/L) | Total amount of full length mAb (mg/L) | Notes/Conditions |
|---|---|---|---|---|---|
| Rituximab | none | shake flask | 3 | n/a | strain M189 |
| MAB01 | pep1 | fermentation | 160 | 3 | pH 4.8; 28° C.; 9 g/l casaminoacids; 20 g/L spent grain extract, 60 g/L lactose |
| Rituximab | pep1 | fermentation | 152 | 66 | pH 5.2; 22° C.; 9 g/l casaminoacids; 20 g/L spent grain extract, 60 g/L lactose and pH 5.2; 30->22° C.; 40 g/L spent grain, 60 g/L glucose |
| | | | 237 | n/a | |

TABLE 6.1-continued

Summary of quantity and quality of antibodies produced by crude fermentor supernatant cultures from *T. reesei* strains described in Examples.

| | | | | | |
|---|---|---|---|---|---|
| MAB01 | pep1, tsp1 | fermentation | 67 | n/a | pH 5.2; 22° C.; 9 g/l casaminoacids; 20 g/L spent grain extract, 60 g/L lactose |
| MAB01 | pep1 | fermentation | 205 | n/a | strain M244; pH 5.5; 28->22° C.; 9 g/L casaminoacids; 20 g/L spent grain extract, 60 g/L lactose + Chymostatin + SBTI; Carrier free LC. |
| MAB01 | pep1 tsp1 | fermentation | 261 | <130 | strain M247; pH 5.5; 22° C.; 9 g/l casaminoacids; 20 g/L spent grain extract, 60 g/L lactose |
| MAB01 | pep1 slp2 | fermentation | 202<br>221 | 60<br>67 | strain M292; pH 5.5; 30->22° C.; 20 g/L spent grain extract, 60 g/L lactose or pH 5.5; 30->22° C.; 40 g/L spent grain, 30 g/L glucose |
| MAB01 | pep1 slp3 | fermentation | 93 | n/a | strain M295; pH 5.5; 22° C.; 9 g/L casaminoacids; 20 g/L spent grain extract, 60 g/L lactose |
| MAB01 | pep1 gap1 | fermentation | 107 | n/a | pH 5.5; 22° C.; 9 g/L casaminoacids; 20 g/L spent grain extract, 60 g/L lactose |
| MAB01 | pep1 slp1 | fermentation | 136 | 19 | strain M298; pH 5.5; 28->22° C.; 9 g/L casaminoacids; 20 g/L spent grain extract, 60 g/L lactose |
| MAB01 | pep1 slp1 | fermentation | 94 | n/a | strain M299; pH 5.5; 22° C.; 9 g/L casaminoacids; 20 g/L spent grain extract, 60 g/L lactose |
| MAB01 | pep1 tsp1 slp1 | fermentation | 2159<br>3500<br>1200<br>1344 | 1471<br>2500<br>822<br>731 | strain M304; pH 5.5; 30->22° C.; 40 g/L spent grain, 40 g/L glucose, 40 g/L lactose or pH 5.5; 28->22° C.; 60 g/L spent grain, 30 g/L glucose, 60 g/L lactose + lactose feed or pH 5.5; 30->22° C.; 50 g/L spent grain, 30 g/L glucose or pH 5.5; 30->22° C.; 40 g/L spent grain, 40 g/L glucose, 40 g/L lactose |
| MAB01 | pep1 tsp1 slp1 gap1 | fermentation | 1965 | 897 | strain M371; pH 5.5; 30->22° C.; 40 g/L spent grain, 40 g/L, glucose, 40 g/L lactose |

In Table 6.1, the total amount of antibody (mAb) is the amount of protein that was purified from the culture supernatant. After protein purification, the antibody was run in size exclusion chromatography to measure the amount of full length assembled antibody. This amount was then referred to as "Full mAb."

As shown in Table 6.1, the M304 triple deletion strain (Δpep1 Δtsp1Δslp1) achieved an antibody yield of 3500 mg/L total IgG, with 2500 mg/L being correctly assembled into full length MAB01 antibody. This corresponds to 71% of full length antibody. The improvement in the percentage of full length antibody was a result of the slp1 deletion. In contrast to the M304 strain, the M247 double deletion strain (Δpep1Δtsp1) achieved a 43% production yield of full length antibody (pH 5,5; 22° C.; 9 g/l casaminoacids; 20 g/L spent grain extract, 60 g/L lactose). Thus, it can directly be seen that the addition of the Δslp1 deletion increases the product quality significantly (by 25%).

Antibody Quality Improvement in M507 MAB01 Production Strain

Figure 49A:
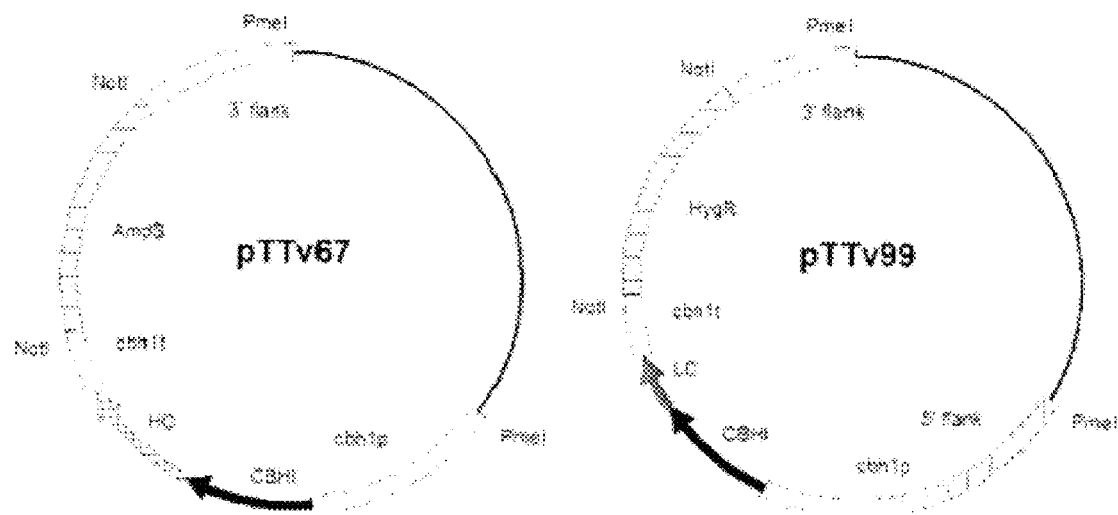
FIG. 49A: Schematic drawings for the expression plasmids pTTv67 and pTTv99. The MAB01 heavy chain is contained within in the pTTv67 vector and the light chain is contained within the pTTv99 vector.
Figure 49B:
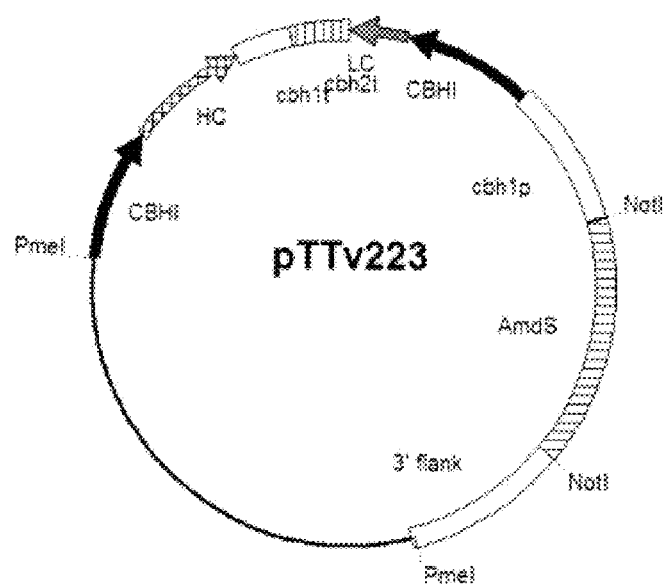
FIG. 49B: Schematic drawing for the expression vector pTTv223. The MAB01 heavy and light chain is contained within the pTTv223 vector.

Two MAB01 production strains were produced, M304 in a 3 protease deletion background and M507 in a 7 protease deletion background. The M304 strain was constructed with separate cassettes for the heavy and light chain (FIG. 49). The heavy chain was integrated into the cbh1 locus and the light chain into the egII locus. The M507 strain was made by integrating a tandem cassette containing both the heavy and light chain into the CBHI locus (FIG. 49). MAB01 tandem vector orients the heavy and light chains in opposite directions. The light chain uses the NVISKR cleavage site and the heavy chain uses the DGETVVKR cleavage site. The M304 strain has 3 proteases pep1, tsp1, and slp1 deleted. The M507 has 7 proteases pep1, tsp1, slp1, gap1, gap2, pep4, pep3 deleted. Both strains overexpress kex2 protease.

The MAB01 bidirectional tandem vector pTTv223 was transformed to the seven-fold protease deletion strain M486 with kex2 overexpression using standard protoplast transformation. Transformants were selected on acetamide-triton plates and first streaks were PCR screened for the 5' and 3' integration of the AmdS marker to the cbhI locus. Double positive transformants were purified through single spore cultivations and spore stocks were generated on PD plates supplemented with ampicillin.

The M304 and M507 strains were cultivated in fermentors with 30 g/l glucose, 60 g/l spent grain, 60 g/l lactose with lactose feed at 28° C. and shifted to 22° C. later in the culture. The M507 strain was cultivated at pH 5.2 (cultivation bio00541b) and pH 5.5 (cultivation bio00543b). The M304 strain was grown at pH 5.5 (cultivation bio00503b). The M304 fermentation bio00477b sample was included as a control in the bio00503b immunoblot. The bio00477b cultivation was done with the same medium and conditions as described for bio00503b.

Figure 50A:
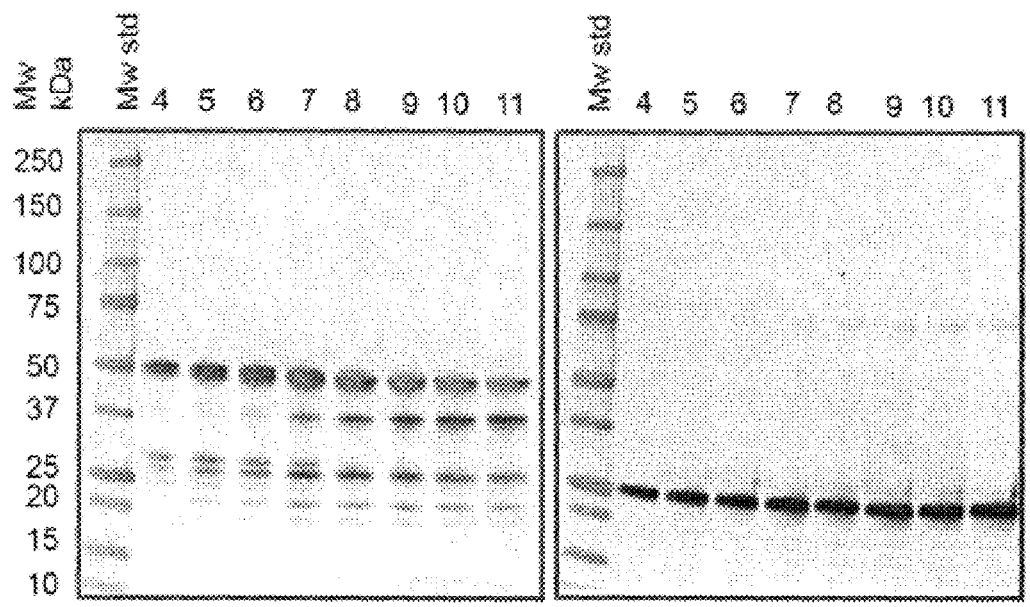
FIG. 50A: Western blot analysis MAB01 light and heavy chain production in pH 5.2 in a fed batch fermentation of the MAB01 production strain M507. The antibodies used were Sigma A3188 against the heavy chain (left blot) and Sigma A3813 against the light chain (right blot), both at 1:10,000 dilutions. Sample codes denote fermentation time in days. 0.1 μl of supernatant was loaded into each lane in both blots.
Figure 50B:
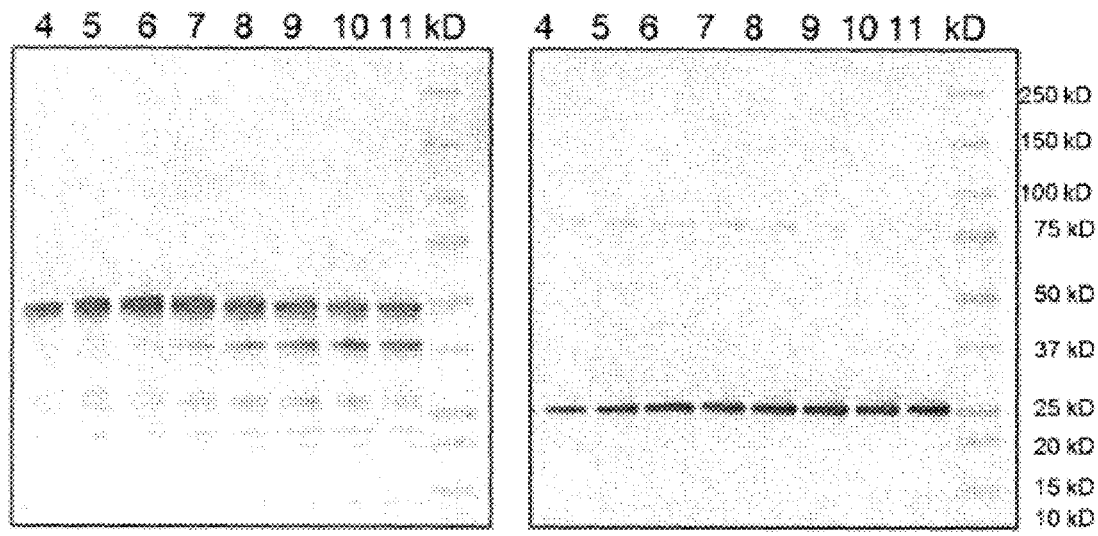
FIG. 50B: Western blot analysis of MAB01 light and heavy chain production in the fed batch fermentation of the MAB01 production strain M507 at pH 5.5. The antibodies used were Sigma A3188 against the heavy chain (blot to the left) and Sigma A3813 against the light chain (blot to the right), both at 1:10,000 dilutions. Sample codes denote fermentation time in days. 0.1 μl of supernatant was loaded into each lane in both blots.
Figure 51:
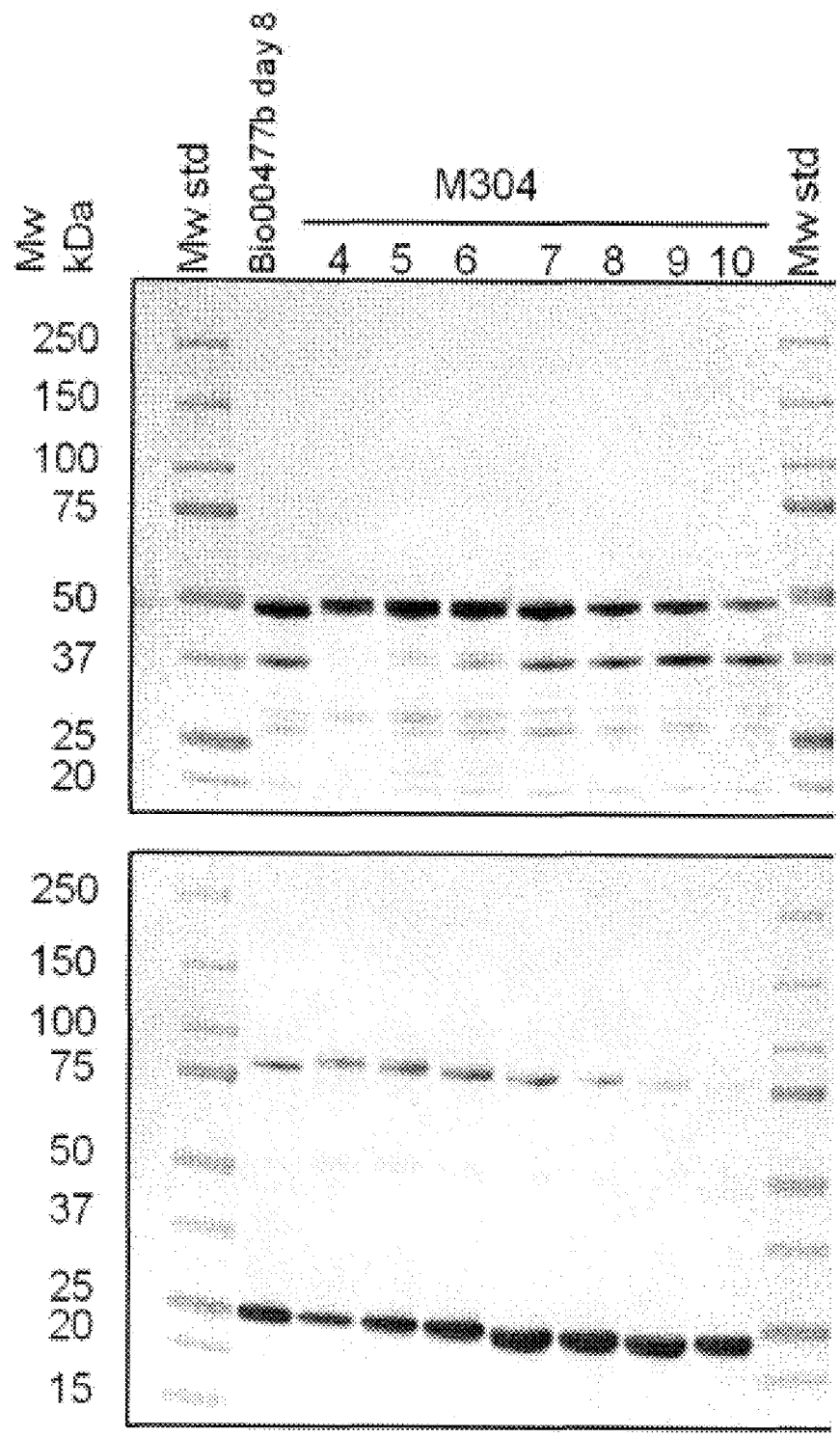
FIG. 51. Western blot analysis MAB01 light and heavy chain production in strains M304 in the fed batch fermentation bio00503b at pH 5.5. The antibodies used were Sigma A3188 against the heavy chain and Sigma A3813 against the light chain. The day 8 from the M304 fermentation bio00477b was included as a control. Sample codes denote fermentation time in days. 0.1 μl of supernatant was loaded in both blots. The uppermost immunoblot is the heavy chain and lower immunoblot is the light chain.

The M507 strain was cultivated at both pH 5.2 and pH 5.5 to study the effect of the pH on antibody production. Supernatant samples from the pH 5.2 fermentation were analyzed by Western blot and shown in FIG. 50A and samples from the pH 5.5 fermentation shown in FIG. 50B. The antibody produced looked rather similar in both M507 cultivations. There was somewhat more light chain in the pH 5.2 conditions. In both cultivations there were heavy chain fragments. The M304 strain was cultivated at pH 5.5 and the results can be seen in FIG. 51. The amount of full length heavy chain produced drops off after day 7 in the M304 strain. The amount of heavy chain goes down after day 9 in the M507 strain. The other difference between the strains was the amount of light chain produced. The M304 produced significantly more.

Protein G purified immunoglobulin concentrations from the three fermentation runs can be seen in Table 6.2. The highest total antibody concentration for the M304 strain was 3.1 g/l on day 9. The highest concentrations for the M507 strain were at day 10, 3.0 g/l at pH 5.2 and 2.8 g/l at pH 5.5. After size exclusion chromatography the amount of full-length antibody was calculated for each sample (Table 6.3). The highest full-sized antibody amount was 2.0 g/l for both M507 fermentations at day 8 (pH 5.2) and day 9 (pH 5.5). The M304 produced a similar 2.0 g/l level of full-length antibody on day 8.

TABLE 6.2

Total antibody concentration determined after protein G purification from culture samples.

| | Total Ab | | |
| --- | --- | --- | --- |
| Day | M304 bio00503b pH 5.5 mg/L | M507 bio00541b pH 5.2 mg/L | M507 bio00543b pH 5.5 mg/L |
| 5 | 2300 | 1200 | 1164 |
| 6 | 2800 | 1427 | 1454 |
| 7 | 3000 | 2211 | 2116 |
| 8 | 3000 | 2745 | 2455 |
| 9 | 3100 | 2721 | 2709 |
| 10 | 2100 | 2995 | 2808 |
| 11 | | 2702 | 2164 |

The difference between the M304 and M507 strains becomes obvious when considering the percentage of full-length antibody produced over the time course of the cultivations. The percentage of full-length antibody was higher with the M507 compared to the strain M304. The M507 strain grown at pH 5.5 produced the highest quality antibody, up to 78% being full-length on day 7. The M304 reached 68% on day 6, but then the product quality decreases compared to M507. The M507 product was 73% full-length until day 9.

TABLE 6.3

The concentration of full-length antibody was calculated after size exclusion chromatography.

| | Full sized Ab | | |
| --- | --- | --- | --- |
| Days | M304 bio00503b pH 5.5 mg/L | M507 bio00541b pH 5.2 mg/L | M507 bio00543b pH 5.5 mg/L |
| 6 | 1900 | 1062 | 1074 |
| 7 | 2000 | 1557 | 1645 |
| 8 | 2000 | 1998 | 1859 |
| 9 | 1700 | 1924 | 1988 |
| 10 | 900 | 1871 | 1806 |

TABLE 6.4

Percentage of full-length antibody produced over the time course of the cultivations.

| | Full sized % | | |
| --- | --- | --- | --- |
| Day | M304 bio00503b pH 5.5 % | M507 bio00541b pH 5.2 % | M507 bio00543b pH 5.5 % |
| 6 | 68 | 74 | 74 |
| 7 | 67 | 70 | 78 |
| 8 | 60 | 73 | 76 |
| 9 | 56 | 71 | 73 |
| 10 | 44 | 62 | 64 |

Protease Activity Measurements

The protease activity in the supernatant was compared between the M304 and M507 strains grown under the same conditions. The Triab62 and Triab67 cultivations were grown at pH 5.5 in 30 g/l glucose, 60 g/l lactose, 20 g/l whole spent grain, 20 g/l spent grain extract with lactose feed at 28° C. and shifted to 22° C. later in the culture.

The protein concentrations were determined from all supernatant samples from day 2-7. All the supernatants were diluted in sodium citrate buffer pH 5.5, so that all the samples had a total protein concentration of 0.625 mg/ml. 100 µl of all the diluted supernatants were added into a black 96 well plate, using 3 replicate wells per sample. 100 µl of casein FL diluted stock (10 µg/ml) made in sodium citrate buffer pH 5.5 was added to each supernatant containing well. The plates were incubated covered in plastic bag at 37° C. The fluorescence from the wells was measured after 2, 3, and 4 hours. The readings were done on the Varioskan fluorescent plate reader using 485 nm excitation and 530 nm emission.

The protease activity in supernatant from the 7-fold protease deletion strain M507 was 2- to 2.5-times lower than M304 (3 protease deletions), see Table 6.5. The acidic proteases deleted (gap1, gap2, pep4, pep3) contribute to this improvement. The general protease activity in the 7-fold deletion strain is noticeably lower with the casein substrate. This data generally correlates to the results seen with percentage full length antibody. Lower protease activity leads to higher quality antibody.

TABLE 6.5

Protease activity in fermentation supernatant from pH 5.5 cultures. Casein was used as the substrate for the measurements.

| Day | M304 Triab62 pH 5.5 | M507 Triab67 pH 5.5 |
|---|---|---|
| 1 | 1.4 | 1.3 |
| 2 | 8.5 | 1.8 |
| 3 | 67.4 | 4.1 |
| 4 | 98.8 | 38.3 |
| 5 | 102.3 | 48.3 |
| 6 | 83.3 | 54.6 |
| 7 | 103.1 | 54.5 |
| 8 | 109.8 | 55.3 |
| 9 | 120.9 | 61.1 |
| 10 | 134.9 | 70.0 |
| 11 | 148.0 | 76.2 |

Example 7—Production of Non-Antibody Proteins

The protease stability of the model proteins IGF1, hGH, and IFNα2b were analyzed by spiking them into supernatant from the 6-fold protease deletion strain (Δpep1Δtsp1Δslp1Δgap1Δgap2Δpep4) M400. The supernatant was collected from a large shake flask culture CAH15. The undiluted supernatant from the shake flask cultivation CAH15 was incubated with the purified model proteins with and without pepstatin A (50 µM) and SBTI (0.2 mg/ml) inhibitors for 20 hours at 37° C. The 5 day culture supernatant pH was around 4.2. The reaction containing 0.05 µg µl of model protein was sampled after 20 hours. 50 mM sodium citrate pH 4.0 spiked with model proteins (0.05 g 1) was used as a buffer control.

From each reaction 10 µl was loaded into an 18% SDS PAGE gel and run for 30 minutes at 200 V. The proteins in the gel were then transferred to nitrocellulose for immunoblotting. The nitrocellulose membrane was blocked for 1 hour at room temperature with 5% milk in TBST buffer. The individual blots were probed with their specific primary antibody to detect the appropriate model protein for 1 hour at room temperature on a shaker. The mouse anti-IGF1 antibody (R&D systems #mab291) was used at 2 µg/ml diluted in TBST. The mouse anti-rhGH antibody (Abeam #ab51232) was used at 2 µg/ml diluted in TBST. The mouse anti-IFNα2b antibody (Abeam #ab9386) was used at 1 µg/ml diluted in TBST. After briefly washing the blot membranes with TBST, the secondary antibody was added for 1 hour at room temperature shaking. The secondary goat anti-mouse AP conjugated antibody (Biorad #170-6520) was diluted 1:10,000 in TBST.

Figure 42:
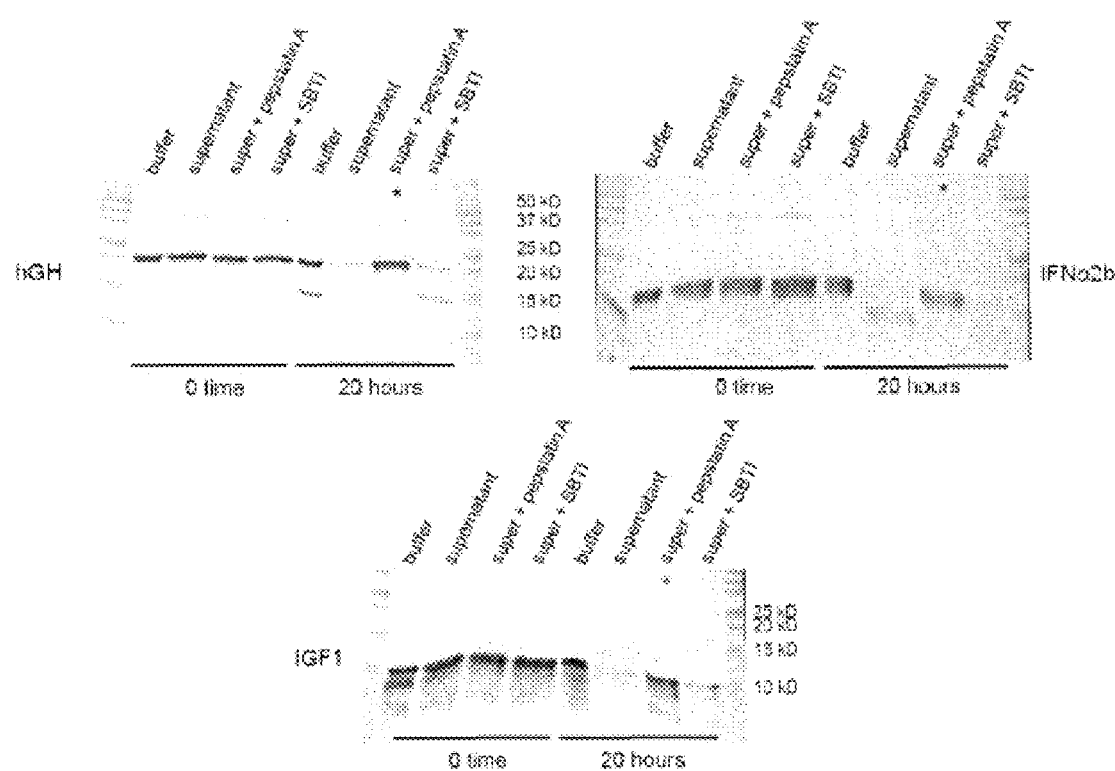
FIG. 42 depicts a degradation study of model proteins. Undiluted supernatant from the 6 protease deletion strain was used at pH 4.2 for spiking in pure model proteins (0.05 μg/ml). 50 mM sodium citrate pH 4.0 spiked with model proteins (0.05 μg/ml) is shown as a buffer control. The spiked supernatant and control were incubated for 20 hours at 37° C. 10 μl of each sample was loaded into 18% SDS PAGE gels. The hGH ran at 22 kD, the IFNα2β ran at 19.4 kD, and the IGF1 ran at 7.5 kD.

When incubated overnight in supernatant, full length proteins were observed for hGH, IFNα2b, and IGF1, although the majority appeared to be degraded (FIG. 42). There was a predominate degradation product for human growth hormone and IFNα2b around 15 kD. However, these 3 model proteins were remarkably stabilized after treating the supernatant with the aspartic protease inhibitor pepstatin A. This inhibitor blocked the key proteases responsible for the majority of the protease activity. The SBTI provided only a small benefit for product stability. Although the pH optimum for SBTI is higher than used in the experiment (pH 4.2 vs. optimal pH 8.0) and thus the binding of these inhibitors to their target proteases may not be most efficient.

Pepstatin A effectively inhibits aspartic proteases. It is known from affinity purification studies with pepstatin A that the remaining aspartic proteases in the supernatant are pep2, pep3, and pep5. Therefore, if the remaining 2 or 3 aspartic proteases were deleted the supernatant will be almost free of aspartic protease activity. For production of these model proteins, the aspartic proteases pep2, pep3, and pep5 would be considered major proteases.

Figure 43:
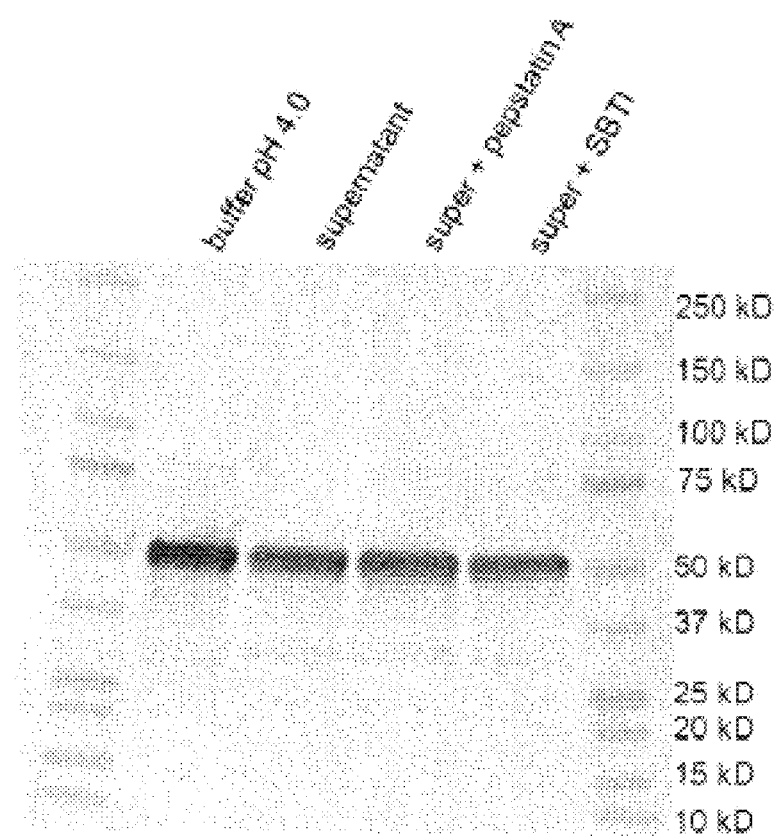
FIG. 43 depicts stability testing of the MAB01 antibody heavy chain in supernatants from the 6 protease deletion strain. The MAB01 antibody was present in undiluted supernatant at 0.05 μg μl. 10 μF of each sample was loaded to a 4-20% SDS PAGE gel. The heavy chain was stable after a 20 hour incubation at 37° C. in supernatant from the 6 protease deletion strain at pH 4.2. The heavy chain was detected with anti-heavy chain IgG AP conjugated antibody (Sigma #A3188) diluted 1:30,000 in TBST. The full length heavy chain ran at 50 kD on the gel.

This same spiking experiment as was done with MAB01 to investigate its stability in the 6 protease deletion supernatant with and without inhibitors (FIG. 43). Samples were taken as described above and immunoblotted with an antiheavy chain AP conjugated antibody (Sigma #A3188). After 20 hours incubation, there was no significant heavy chain degradation. There was no obvious benefit having used inhibitors. The antibody was stable in this pH 4.2 supernatant. The production of MAB01 under more acidic conditions, such as pH 4.5 would likely improve the production yield or at least decrease the amount of heavy chain cleavage that would occur.

To evaluate what inhibitors would best stabilize production of hGH, 24 well cultures of these strains were performed. The M369 human growth hormone strain (Δpep1Δtsp1Δslp1Δgap1Δgap2) was grown along with single components or with combinations of the following: trypsin and subtilisin inhibitor SBTI, the acidic protease inhibitor peptide SIP, the acidic protease inhibitor peptide LIP, the aspartic protease inhibitor pepstatin A free peptide, pepstatin A immobilized to agarose beads, the trypsin and subtilisin inhibitor BBI from lima bean, the subtilisin inhibitor chymostatin, and BSA. Three independent wells were chosen for control wells where no inhibitors or supplements were added. These two strains were grown in 3 ml of TrMM with diammonium citrate without ammonium sulfate, 100 mM PIPPS, 20 g/L spent grain extract, 40 g/L lactose adjusted to pH 4.5. The 24 well plates were shaken at 800 rpm, 85% humidity, and 28° C. The cultures were grown for 6 days and covered with an air permeable membrane.

Inhibitors were added first on day 1 and then daily beginning on day 3. 100 µl samples were taken from the culture wells beginning on day 3. The mycelium was spun down for 5 minutes at 13 k and the supernatant collected. From the culture supernatant 12 µl was loaded in a 4-20% SDS PAGE gel and immunoblotting made on nitrocellulose with mouse anti-hGH antibody (2 µg/ml) and goat anti-mouse IgG AP conjugated secondary antibody diluted 1:10,000 in TBST.

Figure 44:
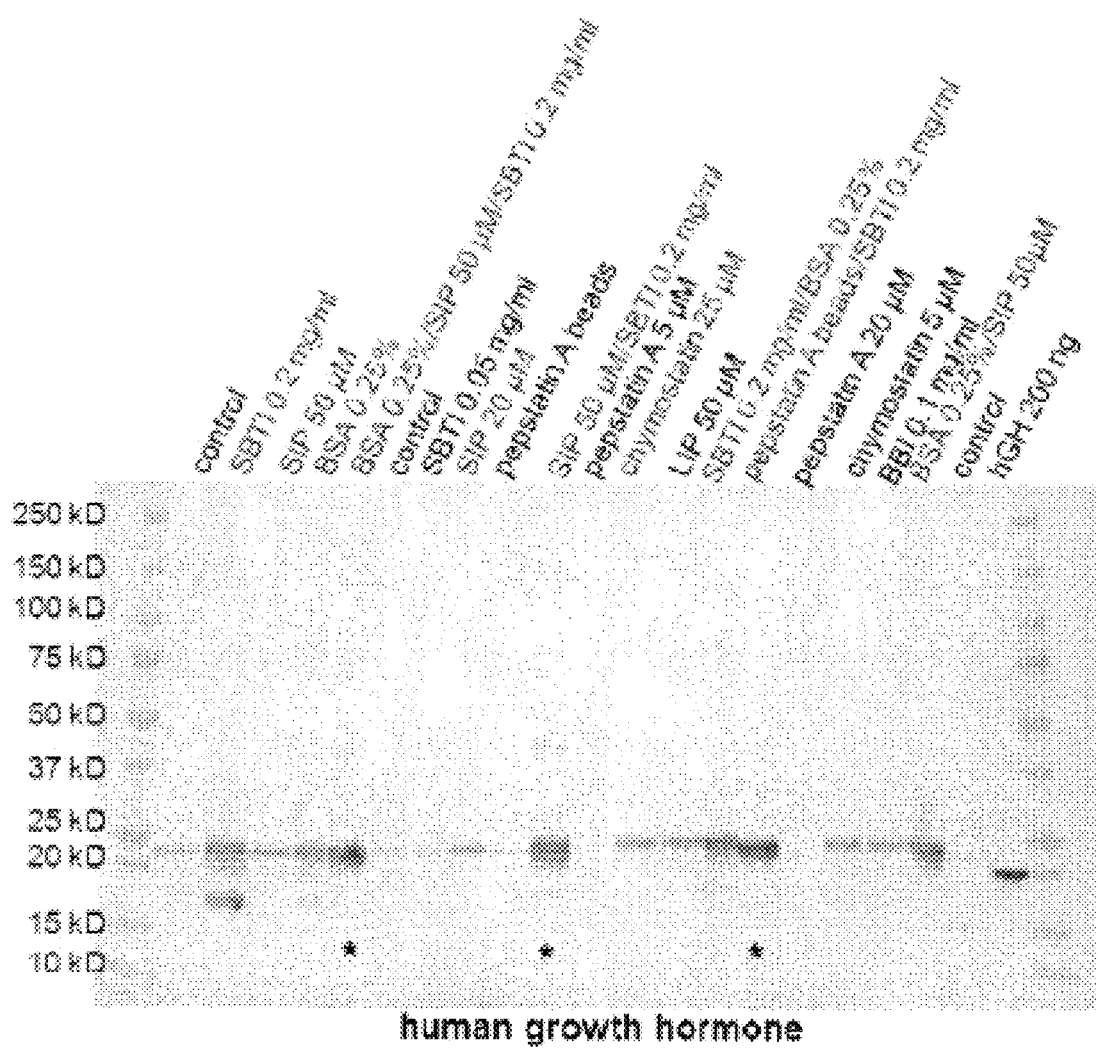
FIG. 44 depicts day 4 samples of human growth hormone from 24 well cultures with and without inhibitors, and supplements. 12 μl of each supernatant was loaded. Primary antibody from Acris, catalog #AM00401PU-N mouse anti-hGH antibody (diluted to 2 μg/ml in TBST) and BioRad (#170-6520) goat anti-mouse IgG AP conjugated secondary antibody diluted 1:10,000. The hGH standard (200 ng), Abcam catalog #ab51232. The full length hGH protein runs at 22 kD.

On day 4, the human growth hormone could still be seen in the culture supernatant in all the 3 control lanes (FIG. 44). Two of the control lanes show a faint band and one control lane shows a light band. The effect of the inhibitors and supplements was immediately observed. The inhibitor/supplements that had a big effect are highlighted in red and those with the best effect are starred. Pepstatin A had a negative effect on the growth hormone production. When used at 5 or 20 μM, production of the hGH seemed to be absent. It appears to have some toxic effect on the production. Only when the pepstatin was immobilized onto agarose beads was this effect negated. One of the best treatments was pepstatin A beads plus 0.2 mg/ml SBTI (see the third star on the blot in FIG. 44). With only SBTI (0.2 mg/ml) there was improved production, but there was a large degradation band present at 18 kD that appears to be produced by the action of aspartic proteases. As expected, this degradation product was reduced by the addition of pepstatin A beads or the SIP peptide inhibitor. The SIP peptide was beneficial even when used alone at 20 or 50 μM. There was a noticeable increase in hGH amount when the SIP peptide was used, but the biggest improvement occurred when used in combination with SBTI or BSA. When chymostatin 5 μM and 25 μM were used it also improved the amount of full length product observed. Supplementing the culture with BSA (0.25%) alone aids production, but did not prevent the large degradation product from forming.

Estimating the expression levels relative to the 200 ng control sample, the control wells produced between 3-6 mg/L of hGH, the BSA (0.25%)/SIP (50 μM)/8BTI (0.2 mg/ml) treatment produced 24.5 mg/L, the SIP (50 μM)/8BTI (0.2 mg/ml) treatment produced 26.6 mg/L, and the pepstatin A beads/SBTI (0.2 mg/ml) addition yielded 24.5 mg/L of hGH. Therefore, using a combination of inhibitors and additives worked best increasing the production levels by at least 4-fold. The critical parameter was to include an aspartic protease inhibitor into the mix.

Example 8—Generation of Pep7 Deficient *T. reesei*

The deletion plasmid for the aspartic protease pep7 (TreID58669) is constructed essentially as described for pep1 deletion plasmid pTTv41 in Example 1. 1062 bp of 5' flanking regions and 1121 bp of 3' flanking region are selected as the basis of the pep7 deletion plasmid. Fragments are produced by PCR using the primers listed in Table 8.1. The products are separated with agarose gel electrophoresis and the correct fragments are isolated from the gel with a gel extraction kit (Qiagen) using standard laboratory methods. Template to be used in the PCR of the flanking regions is from the *T. reesei* wild type strain QM6a. The pyr4 blaster cassette is obtained from pTTv71 (Example 1) with NoiI digestion. The vector backbone is EcoRI/XhoI digested pRS426 as in Example 1. The plasmid is constructed using the yeast homologous recombination method described in Example 1. This deletion plasmid for pep7 results in deletion in the pep7 locus and covers the complete coding sequence of PEP7.

TABLE 8.1

Primers for generation pep7 deletion plasmids.

Deletion plasmid for pep7 (TreID58669), vector backbone pRS426

| Primer | Sequence |
| --- | --- |
| 5flankfw_pRS426 | GTAACGCCAGGGTTTTCCCAGTCACGACGGTTTAAACCATAAACTTGCGCAGTC GAA (SEQ ID NO: 441) |
| 5flankrev_pyr4 | GCGCTGGCAACGAGAGCAGAGCAGCAGTAGTCGATGCTAGGCGGCCGCCTTCTA GGATGGAGCGCTTG (SEQ ID NO: 442) |
| 3flankfw_pyr4 | CAACCAGCCGCAGCCTCAGCCTCTCTCAGCCTCATCAGCCGCGGCCGCAGACGG CTTCTTCCAAAACA (SEQ ID NO: 443) |
| 3flankrev_pRS426 | GCGGATAACAATTTCACACAGGAAACAGCGTTTAAACCCCCAGGGAGGCTATTC TAC (SEQ ID NO: 444) |

For screening integration of pep7 deletion cassette

| Primer | Sequence |
| --- | --- |
| scrn_5forw | CTTTCCAAGCGTTTGAGTCC (SEQ ID NO: 445) |
| T026_Pyr4_orf_5rev2 | CCATGAGCTTGAACAGGTAA (SEQ ID NO: 446) |
| scrn_3rev | GCGTGTTTTATCCTGGTGCT (SEQ ID NO: 447) |
| T028_Pyr4_flank_rev | CATCCTCAAGGCCTCAGAC (SEQ ID NO: 448) |

For screening deletion of pep7 ORF

| Primer | Sequence |
| --- | --- |
| orf_fw | CACCTCCGTCGATGAGTTTT (SEQ ID NO: 449) |
| orf_rev | AGAAGAAGGTGGTGGTGGTG (SEQ ID NO: 450) |

Example 9—Generation of Slp5 Deficient *T. reesei*

The deletion plasmid for the aspartic protease slp5 (TreID64719) is constructed essentially as described for pep1 deletion plasmid pTTv41 in Example 1. 1044 bp of 5' flanking regions and 1003 bp of 3' flanking region are selected as the basis of the slp5 deletion plasmid. Fragments are produced by PCR using the primers listed in Table 9.1. The products are separated with agarose gel electrophoresis and the correct fragments are isolated from the gel with a gel extraction kit (Qiagen) using standard laboratory methods. Template to be used in the PCR of the flanking regions is from the *T. reesei* wild type strain QM6a. The pyr4 blaster cassette is obtained from pTTv71 (Example 1) with NotI digestion. The vector backbone is EcoRI/XhoI digested pRS426 as in Example 1. The plasmid is constructed using the yeast homologous recombination method described in Example 1. This deletion plasmid for slp5 results in deletion in the slp5 locus and covers the complete coding sequence of SLP5.

TABLE 9.1

Primers for generating slp5 deletion plasmids.

Deletion plasmid for slp5 (TreID64719), vector backbone pRS426

| Primer | Sequence |
| --- | --- |
| 5flankfw_pRS426 | GTAACGCCAGGGTTTTCCCAGTCACGACGGTTTAAACGTTTGAGCATTCTCCCAAGC (SEQ ID NO: 451) |
| 5flankrev_pyr4 | GCGCTGGCAACGAGAGCAGAGCAGCAGTAGTCGATGCTAGGCGGCCGCCGCCATTTTGAAGAAGATGC (SEQ ID NO: 452) |
| 3flankfw_pyr4 | CAACCAGCCGCAGCCTCAGCCTCTCTCAGCCTCATCAGCCGCGGCCGCATGCTCCCTCGTCATTAAGC (SEQ ID NO: 453) |
| 3flankrev_pRS426 | GCGGATAACAATTTCACACAGGAAACAGCGTTTAAACACAACACCTTCTCCGACACC (SEQ ID NO: 454) |

For screening integration of slp5 deletion cassette

| Primer | Sequence |
| --- | --- |
| scrn_5forw | ATGCCCAAGTTTCGTACCTG (SEQ ID NO: 455) |
| T026_Pyr4_orf_5rev2 | CCATGAGCTTGAACAGGTAA (SEQ ID NO: 456) |
| scrn_3rev | GGCGCATTCAGAAGAAGAAC (SEQ ID NO: 457) |
| T028_Pyr4_flank_rev | CATCCTCAAGGCCTCAGAC (SEQ ID NO: 458) |

For screening deletion of slp5 ORF

| Primer | Sequence |
| --- | --- |
| orf_fw | CACTTGATGAACGCTGGCTA (SEQ ID NO: 459) |
| orf_rev | CGTAATGGCGTTGTTGACAG (SEQ ID NO: 460) |

Example 10—Generation of Slp6 Deficient *T. reesei*

The deletion plasmid for the aspartic protease slp6 (TreID121495) is constructed essentially as described for pep1 deletion plasmid pTTv41 in Example 1. 1192 bp of 5' flanking regions and 1114 bp of 3' flanking region are selected as the basis of the slp6 deletion plasmid. Fragments are produced by PCR using the primers listed in Table 10.1. The products are separated with agarose gel electrophoresis and the correct fragments are isolated from the gel with a gel extraction kit (Qiagen) using standard laboratory methods. Template to be used in the PCR of the flanking regions is from the *T. reesei* wild type strain QM6a. The pyr4 blaster cassette is obtained from pTTv71 (Example 1) with NotI digestion. The vector backbone is EcoRI/XhoI digested pRS426 as in Example 1. The plasmid is constructed using the yeast homologous recombination method described in Example 1. This deletion plasmid for slp6 results in deletion in the slp6 locus and covers the complete coding sequence of SLP6.

TABLE 10.1

Primers for generating slp6 deletion plasmids.

Deletion plasmid for slp6 (TreID121495), vector backbone pRS426

| Primer | Sequence |
| --- | --- |
| 5flankfw_pRS426 | GTAACGCCAGGGTTTTCCCAGTCACGACGGTTTAAACGAGGCAGCCAAAAAGTGAAG (SEQ ID NO: 461) |
| 5flankrev_pyr4 | GCGCTGGCAACGAGAGCAGAGCAGCAGTAGTCGATGCTAGGCGGCCGCTGAAAGAAGGCAGGACCAGT (SEQ ID NO: 462) |
| 3flankfw_pyr4 | CAACCAGCCGCAGCCTCAGCCTCTCTCAGCCTCATCAGCCGCGGCCGCAAGAGGCTCGGACAAAGACA (SEQ ID NO: 463) |
| 3flankrev_pRS426 | GCGGATAACAATTTCACACAGGAAACAGCGTTTAAACGATCGTGGTGCACGAGACTA (SEQ ID NO: 464) |

For screening integration of slp6 deletion cassette

| Primer | Sequence |
| --- | --- |
| scrn_5forw | GCACTGCGTTGCCTTTCTAT (SEQ ID NO: 465) |
| T026_Pyr4_orf_5rev2 | CCATGAGCTTGAACAGGTAA (SEQ ID NO: 466) |
| scrn_3rev | GAAAGCATGGCTCGTTTCTC (SEQ ID NO: 467) |
| T028_Pyr4_flank_rev | CATCCTCAAGGCCTCAGAC (SEQ ID NO: 468) |

For screening deletion of slp6 ORF

| Primer | Sequence |
| --- | --- |
| orf_fw | ACCCGGCTCAACTAGCTACA (SEQ ID NO: 469) |
| orf_rev | AGCTGGCCTTTCGTTACAGA (SEQ ID NO: 470) |

Example 11—Generation of Slp7 Deficient *T. reesei*

Generation of Slp7 Deletion Plasmid

The deletion plasmid pTTv269 for the serine protease slp7 (tre123865) was constructed essentially as described for pep1 deletion plasmid pTTv41 in Example 1, except that the marker used for selection was pyr4-hgh from pTTv194.

949 bp of 5' flanking region and 1025 bp of 3' flanking region were selected as the basis of the slp7 deletion plasmid pTTv269. These fragments were amplified by PCR using the primers listed in Table 11.1. Template used in the PCR of the flanking regions was from the *T. reesei* wild type strain QM6a. The products were separated with agarose gel electrophoresis and the correct fragments were isolated from the gel with a gel extraction kit (Qiagen) using standard laboratory methods. The pyr4-hgh cassette was obtained from pTTv194 (Apep4-pyr4-hgh) with NotI digestion. To enable removal of the marker cassette, NotI restriction sites were introduced on both sides of the cassette. Vector backbone was EcoKV/XhoI digested pRS426 as in Example 1. The plasmid pTTv269 was constructed with the 5' flank, 3' flank, pyr4-hgh marker, and vector backbone using the yeast homologous recombination method described in Example 1. This deletion plasmid for slp7 (pTTv269, Table 11.1) results in a 2019 bp deletion in the slp7 locus and covers the complete coding sequence of SLP7.

TABLE 11.1

Primers for generating slp7 deletion plasmids.
Deletion plasmid pTTv269 (Δslp7-pyr4-hgh), vector backbone pRS426

| Primer | Sequence |
| --- | --- |
| T1088_slp7_5flkfw_vector | GTAACGCCAGGGTTTTCCCAGTCACGACGGTTTAAACTCCCATAGCCTCTTGAAGG (SEQ ID NO: 750) |
| T1089_slp7_5flkrev_pyr4Prom | GCGCTGGCAACGAGAGCAGAGCAGCAGTAGTCGATGCTAGGCGGCCGCTTTGCAGCAAGATGTCGTTC (SEQ ID NO: 472) |
| T1090_slp7_3flkfw_pyr4loop | CAACCAGCCGCAGCCTCAGCCTCTCTCAGCCTCATCAGCCGCGGCCGCTGGGTGATAAGCTTGGGTTT (SEQ ID NO: 751) |
| T1091_slp7_3flkrev_vector | GCGGATAACAATTTCACACAGGAAACAGCGTTTAAACATCATGATGACCCATCGACA (SEQ ID NO: 752) |

Example 12—Generation of Slp8 Deficient *T. reesei*

Generation of Slp8 Deletion Plasmid

The deletion plasmid pTTv330 for subtilisin-like protease slp8 (tre58698) was constructed essentially as described for pep1 deletion plasmid pTTv41 in Example 1, except that the marker used for selection was a double marker pyr4-hph.

975 bp of 5' flanking region and 1038 bp of 3' flanking region were selected as the basis of the slp8 deletion plasmid. A 298 bp stretch from the end of slp8 5' flank was used as the direct repeat fragment. These fragments were amplified by PCR using the primers listed in Table 12.1. The products were separated with agarose gel electrophoresis and the correct fragments were isolated from the gel with a gel extraction kit (Qiagen) using standard laboratory methods. The pyr4-hph cassette was obtained from pTTv210 (Asep1-pyr4-hph) with NotI digestion. To enable removal of the complete double marker cassette, NotI restriction sites were introduced on both sides of the double marker cassette. AscI site was introduced between the slp8 5'direct repeat and 3' flank. Vector backbone was EcoRI/XhoI digested pRS426 as in Example 1. The plasmid was constructed using the yeast homologous recombination method described in Example 1. This deletion plasmid for slp8 (pTTv330, Table 12.1) results in a 1433 bp deletion in the slp8 locus and cover the complete coding sequence of SLP8.

TABLE 12.1

Primers for generating slp8 deletion plasmid.
Deletion plasmid pTTv330 (Δslp8-pyr4-hph), vector backbone pRS426

| Primer | Sequence |
| --- | --- |
| T1203_slp8_5f_f | GATTAAGTTGGGTAACGCCAGGGTTTTCCCAGTCACGACGGTTTAAACATCGTGCTTGGGCTATTCTG (SEQ ID NO: 595) |

TABLE 12.1-continued

Primers for generating slp8 deletion plasmid.
Deletion plasmid pTTv330 (Δslp8-pyr4-hph), vector backbone pRS426

| Primer | Sequence |
|---|---|
| T1204_slp8_5f_r | GCGCTGGCAACGAGAGCAGAGCAGCAGTAGTCGATGCTAGGCGGCCGCGGA AAGACGCCAGAAAGAAA (SEQ ID NO: 596) |
| T1205_slp8_5dr_f | GTACACTTGTTTAGAGGTAATCCTTCTTTCTAGAAGGAGAGCGGCCGCCGC TCGATGTGGATGATACT (SEQ ID NO: 597) |
| T1206_slp8_5dr_r | ATCTATACTGTCTGCACCAAAAGTACAACAACGCAAACCGGGCGCGCCGGA AAGACGCCAGAAAGAAA (SEQ ID NO: 598) |
| T1207_slp8_3f_f | CGGTTTGCGTTGTTGTACTT (SEQ ID NO: 599) |
| T1208_slp8_3f_r | TGGAATTGTGAGCGGATAACAATTTCACACAGGAAACAGCGTTTAAACACA ACCCAACGTTCTCTCGT (SEQ ID NO: 600) |

Example 13—Protease Homologs

*T. reesei* pep1, pep2, pep3, pep4, pep5, and pep7; tsp1; slp1, slp2, slp3, slp5, slp6, slp7, and slp8; gap1 and gap2; and tpp1 homologs were identified from other organisms.

BLAST searches were conducted using the National Center for Biotechnology Information (NCBI) non-redundant amino acid database using the *Trichoderma reesei* protease amino acid sequences as queries. Alternatively, FASTA searches were conducted with the UniProt Knowledgebase of European Bioinformatics Institute (EBI). *Trichoderma virens* and *Trichoderma atroviride* BLAST searches were conducted using the DOE Joint Genome Institute's web site (*Trichoderma virens* Gv29-8 v2.0 and *Trichoderma atroviride* v2.0, respectively). Sequence hits from the BLAST searches were aligned using the ClustalW2 alignment tool provided by EBI. Phylogenetic trees were also generated using the sequence alignments.

Figure 45:
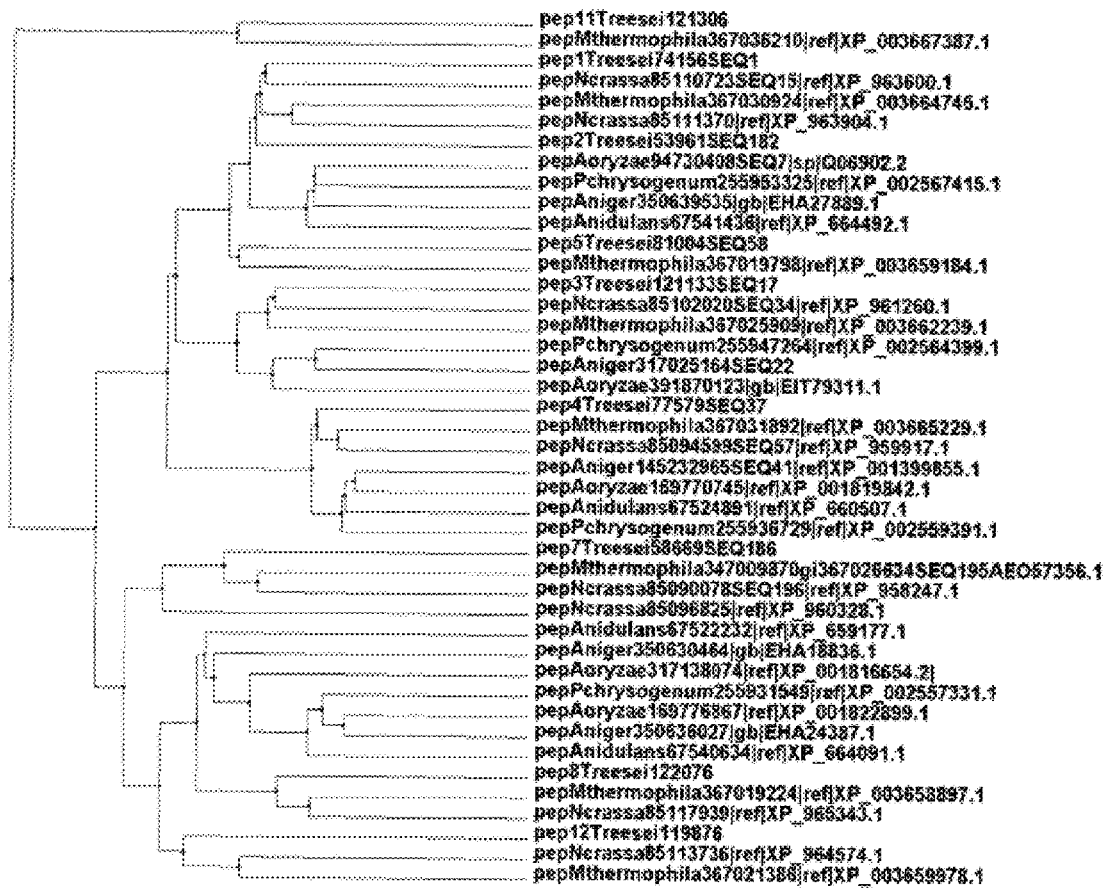
FIG. 45 depicts a phylogeny of aspartic proteases of *T. reesei, Myceliophthora thermophila, Neurospora crassa, Penicillium chrysogenum, Aspergillus oryzae, A. nidulans*, and *A. niger*. The alignment was created with Clustal Omega (http://www.ebi.ac.uk/Tools/msa/clustalo/) and the tree was calculated using average distance with BLOSUM62.

FIG. 45 depicts a phylogenetic tree of aspartic proteases of selected filamentous fungi.

Figure 46:
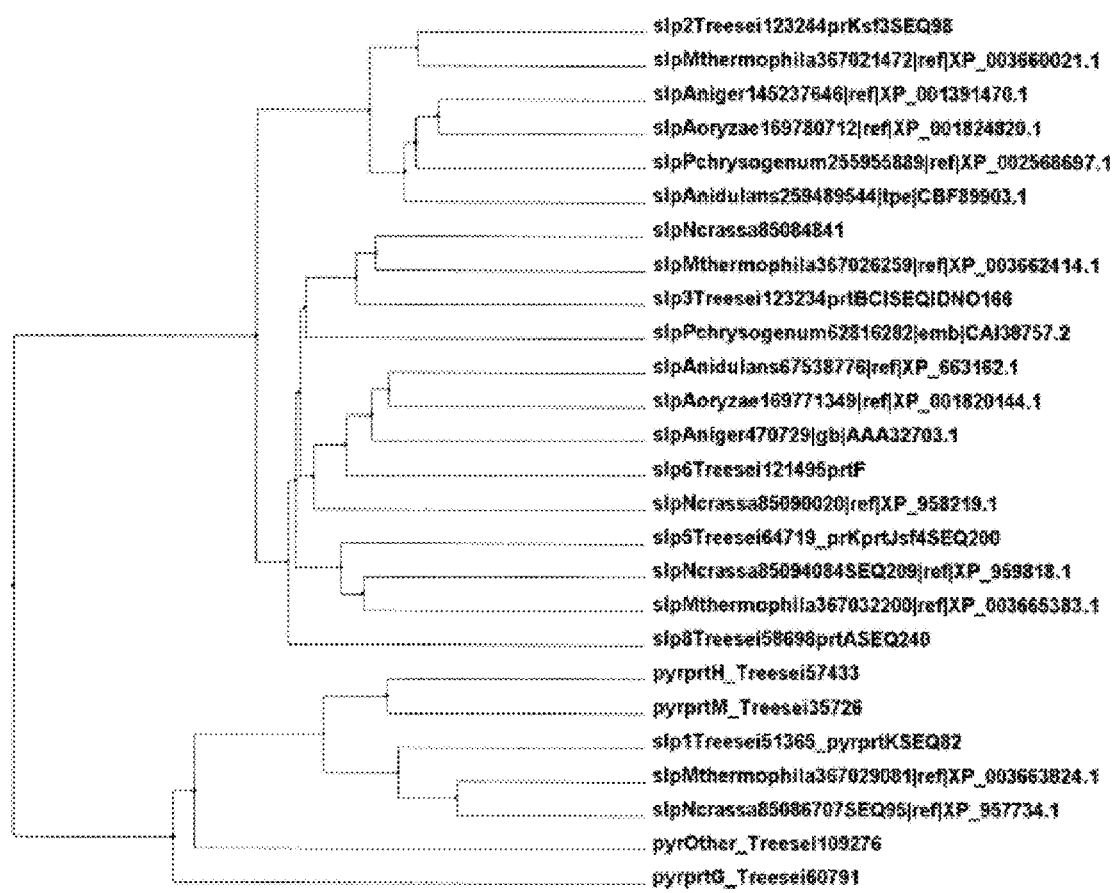
FIG. 46 depicts a phylogeny of subtilisin proteases of *T. reesei, Myceliophthora thermophila, Neurospora crassa, Penicillium chrysogenum, Aspergillus oryzae, A. nidulans*, and *A. niger*. The alignment was created with Clustal Omega (http://www.ebi.ac.uk/Tools/msa/clustalo/) and the tree was calculated using average distance with BLOSUM62. "pyr" means pyrolysin, "prKsf3" means proteinase K, subfamily 3; prtA, prtK, prU, prtF, and prtBCI mean subfamilies as described in Bryant et al. (2009) BMC Evolutionary Biology 9: 168, doi: 10.1186/1471-2148-9-168, FIG. 5 and additional file no. 8.

FIG. 46 depicts a phylogenetic tree of subtilisin proteases of selected filamentous fungi.

Figure 47:
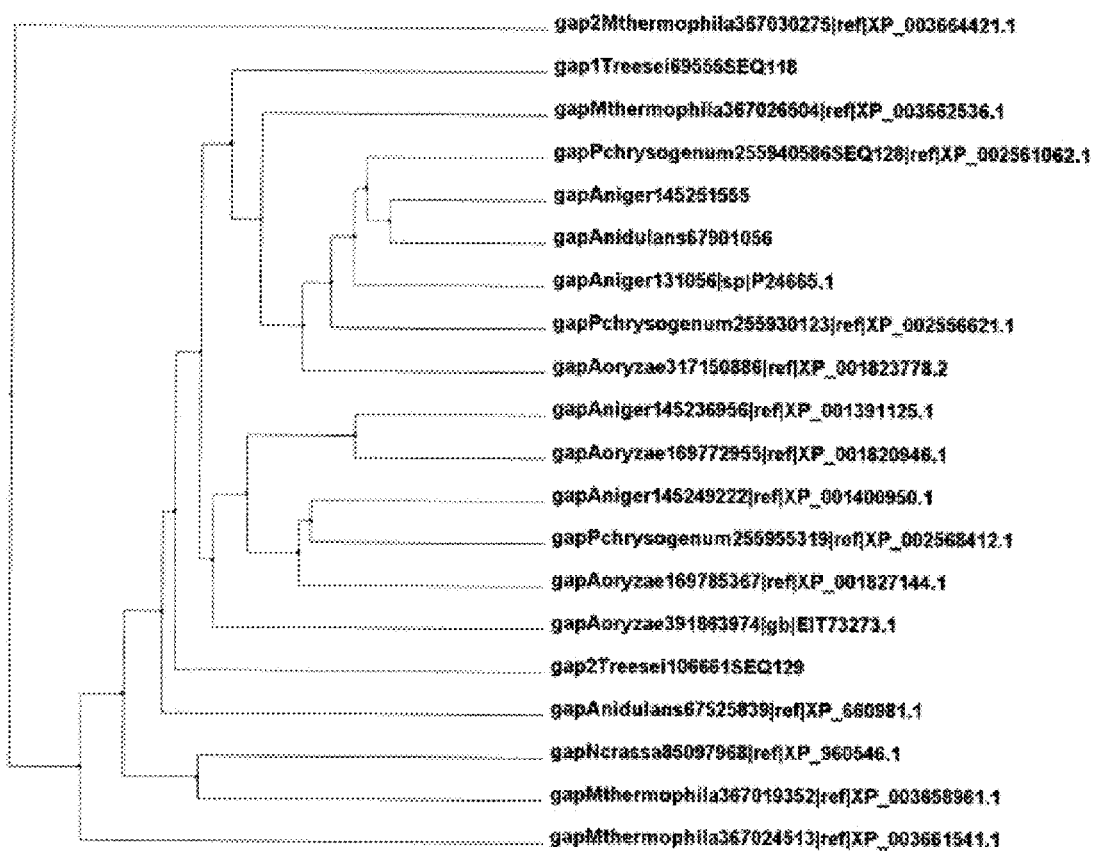
FIG. 47 depicts a phylogeny of glutamic proteases of *T. reesei, Myceliophthora thermophila, Neurospora crassa, Penicillium chrysogenum, Aspergillus oryzae, A. nidulans*, and *A. niger*. The alignment was created with Clustal Omega (http://www.ebi.ac.uk/Tools/msa/clustalo/) and the tree was calculated using average distance with BLOSUM62.

FIG. 47 depicts a phylogenetic tree of glutamic proteases of selected filamentous fungi.

Figure 48:
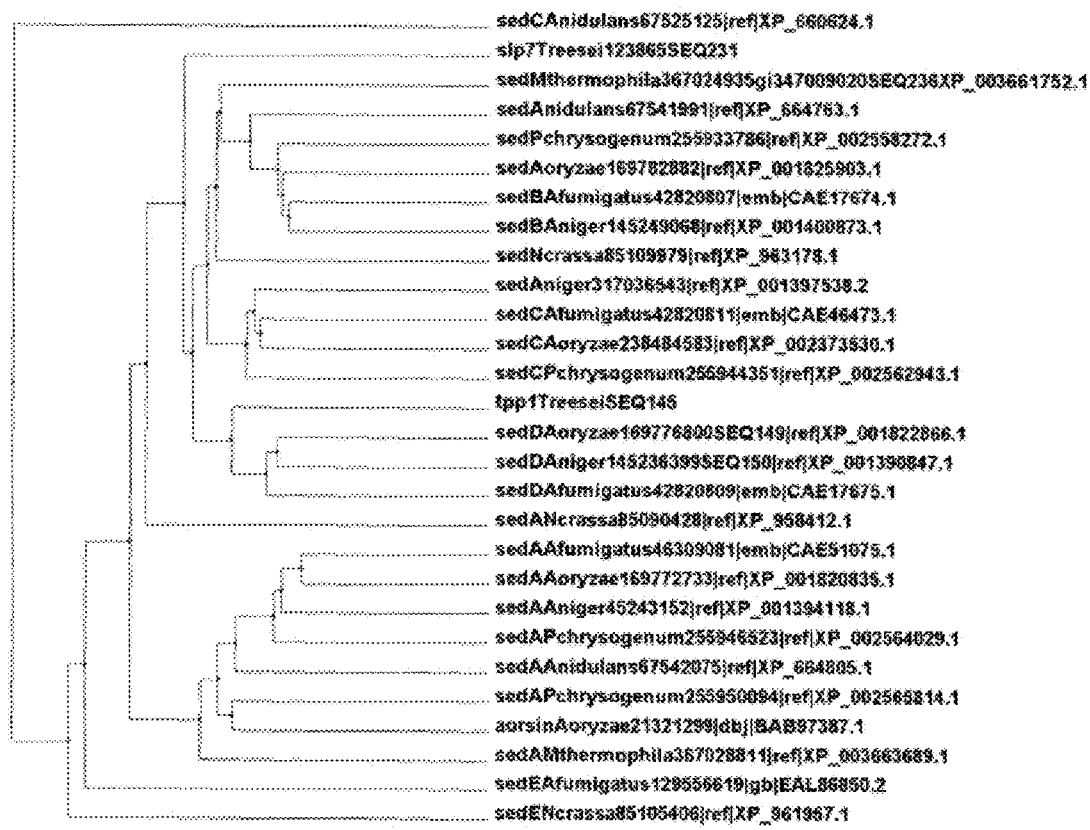
FIG. 48 depicts a phylogeny of sedolisin proteases of *T. reesei, Myceliophthora thermophila, Neurospora crassa, Penicillium chrysogenum, Aspergillus oryzae, A. nidulans*, and *A. niger*. The alignment was created with Clustal Omega (http://www.ebi.ac.uk/Tools/msa/clustalo/) and the tree was calculated using average distance with BLOSUM62. As slp7 resembles sedolisin proteases, it is included in the tree. *Aspergillus fumigatus* sequences are included to aid the determination of the relationships between sedolisins. The abbreviations sedA/B/C/D/E in front of each protease are based on Reichard et al. (2006) APPLIED AND ENVIRONMENTAL MICROBIOLOGY, Vol. 72, p. 1739-1748, FIG. 4, from which BLAST search with *A. fumigatus* sedolisin the corresponding protease was retrieved.

FIG. 48 depicts a phylogenetic tree of sedolisin proteases of selected filamentous fungi.

Example 14—Generation of 9-Fold Protease Deletion Strains

Generation of 9-Fold Protease Deletion Strain Having Deletions Δpep1Δtsp1Δslp1Δgap1Δgap2Δpep4Δpep3Δpep5Δpep2

Generation of New Pep2 Deletion Plasmids

The first deletion plasmid, pTTv213, for the aspartic protease pep2 (tre0053961) was constructed essentially as described for the Δpep1 plasmid pTTv41 in Example 1, but an additional second selection marker cassette carrying hygromycin phosphotransferase gene (hph), was placed after the pyr4 gene creating a deletion plasmid with a double selection marker blaster cassette. The double marker system enables a) utilisation of e.g. hph as the initial resistance marker and faster selection; b) transformation of pyr4+ strains (without the need to generate pyr4-prior to transformation); and c) removal of both markers from the transformants using 5-fluoroorotic acid (like in removal of standard pyr4 blaster cassette) and simultaneous mutagenization of the endogenous pyr4 resulting in marker-free, pyr4⁻ strain. In addition to the double marker, the first deletion plasmid contained also an overexpression cassette for native KEX2 (tre123561; promoter cDNA1, terminator cbh2).

The second deletion plasmid for the aspartic protease pep2 (tre0053961), pTTv232, was constructed using the plasmid pTTv213 above as the backbone. The kex2 overexpression cassette (pcDNA1-kex2-tcbh2) was removed from pTTv213 with AscI digestion. Cloning of the plasmid pTTv232 was done with standard ligation (self-ligation) using T4 DNA ligase at room temperature. Part of the ligation mixture was transformed into *E. coli* with electroporation. A few clones were cultivated, plasmid DNA was isolated and digested to screen for correct ligation using standard laboratory methods. Correct ligation was further verified by sequencing.

The third deletion plasmid for the aspartic protease pep2 (tre0053961), pTTv246, was constructed using the plasmid pTTv232 above as the backbone. The pyr4-hph double marker was removed from pTTv232 with NotI digestion. The pyr4 marker gene was obtained from pTTv181 (Δpep4-pyr4 above) with NotI digestion. Cloning of the plasmid pTTv246 was done with standard ligation using T4 DNA ligase at room temperature. Part of the ligation mixture was transformed into *E. coli* with electroporation. A few clones were cultivated, plasmid DNA was isolated and digested to screen for correct ligation using standard laboratory methods. Correct ligation and orientation of the marker was further verified by sequencing.

1000 bp of 5' flanking region and 1020 bp of 3' flanking region were selected as the basis of the pep2 deletion plasmids. A 300 bp stretch from the end of pep2 5' flank was used as the direct repeat fragment. These fragments as well as the second selection marker cassette (hph), cDNA1 promoter, native kex2 gene and cbh2 terminator were amplified by PCR using the primers listed in Table 14.1. The products were separated with agarose gel electrophoresis and the correct fragments were isolated from the gel with a gel extraction kit (Qiagen) using standard laboratory methods. The pyr4 selection marker was obtained from pTTv181 (Δpep4-pyr4 above) with NotI digestion. To enable removal of the complete double marker cassette in pTTv213, NotI restriction sites were introduced on both sides of the double marker cassette, and a SwaI site between the two selection markers. AscI sites were introduced on both sides of the kex2 overexpression cassette (between pep2 5'direct repeat and 3' flank). Vector backbone was EcoRI/XhoI digested pRS426 as in Example 1. The plasmid pTTv213 was constructed using the yeast homologous recombination method described in Example 1. These deletion plasmids for pep2 (pTTv213, pTTv232 and pTTv246, Table 14.1) result in a 1580 bp deletion in the pep2 locus and cover the complete coding sequence of PEP2.

No growth was observed on the plates without uridine supplementation. Resulting strain used in generation of 9-fold protease deletion strain was designated with strain number M521.

To remove vector sequence, plasmid pTTv246 (Δpep2-pyr4) was digested with MssI and the correct fragment

TABLE 14.1

Primers for generating pep2 deletion plasmids.

| Primer | Sequence |
|---|---|
| Deletion plasmid pTTv213, vector backbone pRS426 | |
| T43 1_pep2-5flankF-pRS426 | GATTAAGTTGGGTAACGCCAGGGTTTTCCCAGTCACGACGGTTTAAACCGG TTGTCCATTTCATCCTTC (SEQ ID NO: 601) |
| T629_pep2_5f_rev_pyr4 | GCGCTGGCAACGAGAGCAGAGCAGCAGTAGTCGATGCTAGGCGGCCGCGGG GAAGCAAGTTTCGAAGT (SEQ ID NO: 602) |
| T630_pep2_5DR_for_trpC | GTACACTTGTTTAGAGGTAATCCTTCTTTCTAGAAGGAGAGCGGCCGCCTC CACGCTCTTGGCCAC (SEQ ID NO: 603) |
| T63 1_pep2_5DR_rev_cDNA1 | GTCATTAAGTCCATCATTCCACGTCCTTCAGACCGAATTCGGCGCGCCGGG GAAGCAAGTTTCGAAGT (SEQ ID NO: 604) |
| T632_pep2_3f_for_tcbh2 | ATGATGCCTTTGCAGAAATGGCTTGCTCGCTGACTGATACGGCGCGCCTAT CGCGAAAGTAGCCAATA (SEQ ID NO: 605) |
| T633_pep2_3f_rev | AGCGGATAACAATTTCACACAGGAAACAGCGTTTAAACCATCCTTTTCCTC ACCACGA (SEQ ID NO: 606) |
| T491_hph_recpyr4_f0r3 | TGATTGTACCCCAGCTGCGATTGATGTGTATCTTTGCATGATTTAAATTCT CCTTAGCTCTGTACAGT (SEQ ID NO: 607) |
| T492_hph_rev2 | GCGGCCGCTCTCCTTCTAGAAAGAAGGA (SEQ ID NO: 608) |
| T495_cDNA1_for | GAATTCGGTCTGAAGGACGT (SEQ ID NO: 609) |
| T138_cDNA1_Rev | GTTGAGAGAAGTTGTTGGATTG (SEQ ID NO: ) |
| T139_123561For_cDNA1 | AACCAAAGACTTTTTGATCAATCCAACAACTTCTCTCAACATGAAGATTTC CTCGATCCTTG (SEQ ID NO: 393) |
| T516_123561Rev | TCAGCGCCGTAACCTCTGC (SEQ ID NO: 394) |
| T496_tcbh2_for | TGATGGTGATGAGGCGGAAAAGCAGAGGTTACGGCGCTGAGGCTTTCGTGA CCGGGCTTC (SEQ ID NO: 610) |
| T497_tcbh2_rev | GTATCAGTCAGCGAGCAAGC (SEQ ID NO: 611) |
| Deletion plasmid pTTv232 | |
| no new primers, pTTv213 digested with AscI (to remove kex2 overexpression cassette) and self-ligated | |
| Deletion plasmid pTTv246 | |
| No new primers, pTTv232 digested with NotI and ligated with pyr4/NotI-fragment from pTTv181 | |

Generation of 9-Fold Protease Deletion Strain with Pep2 (Tre53961); M574

To generate a marker-free 9-fold protease deletion strain, removal of the pyr4 marker was applied to the 8-fold deletion strain M504 (38-48A, pTTv229 in M496) essentially as described in Example 3 for removal of the pyr4 blaster cassette from the strain M195 {Δpep1}. Consecutive 5-FOA selection steps were carried out to ensure that the clones selected were originating from single cells.

Final clones were verified by PCR using the primers listed in Table 14.2 with standard laboratory methods. Signal corresponding to successful removal of the blaster cassette was obtained for majority of the clones. Removal of the blaster cassette was further verified by plating the clones onto minimal medium plates with or without 5 mM uridine.

purified from an agarose gel using a QIAquick Gel Extraction Kit (Qiagen). Approximately 5 μg of the deletion cassette was used to transform a clone of 8-fold protease deletion strain M521 (Δpep1Δtsp1Δslp1Δgap1Δgap2Δpep4 Δpep3Δpep5, pyr4⁻). Preparation of protoplasts and transformation were carried out essentially as described in Example 1 for the strains M181 and M195 using pyr4 selection.

Transformants were picked as first streaks. Growing streaks were screened by PCR (using the primers listed in Table 14.2) for correct integration. Clones giving the expected signals were purified to single cell clones and rescreened by PCR using the primers listed in Table 14.2. Deletion of pep2 was verified by Southern analyses from selected clones (data not shown) using methods described in Example 1. Clone 41-45G was designated with strain number M574.

TABLE 14.2

Primers for screening removal of pyr4 blaster cassette from 8-fold protease deletion strain and for screening of pTTv246/Δpep2-pyr4 integration and strain purity.

| Primer | Sequence |
|---|---|
| For screening removal of pyr4 blaster cassette from M504 and strain purity | |
| T858_pep5_5f_f3 | GGAATCGTCACCAAGGAG (SEQ ID NO: 612) |
| T755_pep5_3f_rev3 | CTTCTGGTGACATTCCGAC (SEQ ID NO: 613) |
| T627_pep5_5int_new | GTCGAAGATGTCCTCGAGAT (SEQ ID NO: 432) |
| T488_pyr4_5utr_rev | GGAGTTGCTTTAATGTCGGG (SEQ ID NO: 433) |
| T860_pep5_orf_f3 | GTCGAGCGTCTGATATTCAC (SEQ ID NO: 439) |
| T861_pep5_orf_r2 | GACGGAGACCTCCCACA (SEQ ID NO: 440) |
| For screening integrations of pTTv246 (Δpep2-pyr4) | |
| T596_pep2_fwd 5'flank screen | CCTCTGCGTTGAGCAACATA (SEQ ID NO: 614) |
| T026_Pyr4_orf_5rev2 | CCATGAGCTTGAACAGGTAA (SEQ ID NO: 456) |
| T061_pyr4_orf_screen_2F | TTAGGCGACCTCTTTTTCCA (SEQ ID NO: 382) |
| T600_pep2 rev 3'flank screen | CGAAAGCGTGGAGTCTTCTC (SEQ ID NO: 615) |
| For screening deletion of pep2 (tre53961) ORF | |
| T601_pep2 fwd | GACGTGGTACGACAACATCG (SEQ ID NO: 269) |
| T623_pep2 rev | TATCAAGGTACCGGGGACAG (SEQ ID NO: 270) |
| T1077_pep2_orf_probef2 | AACAAAGCCTTCACAGGCC (SEQ ID NO: 616) |
| T1078_pep2_orf_prober2 | TGAGGCTCCTTCCAACTTTT (SEQ ID NO: 617) |

Generation of 9-Fold Protease Deletion Strain Having Deletions Δpep1Δtsp1Δslp1Δgap1Δgap2Δpep4Δpep3Δpep5Δpep12

Generation of Pep12 Deletion Plasmids

The first deletion plasmid, pTTv209, for the aspartic protease pep12 (tre1 19876) was constructed essentially as described for the Δpep1 plasmid pTTv41 in Example 1, but an additional second selection marker cassette, a synthetic construct carrying a phosphinothricin N-acety transferase gene (bar) of *Streptomyces* ssp., was placed after the pyr4 gene creating a deletion plasmid with a double selection marker blaster cassette. The double marker system enables a) utilisation of e.g. bar as the initial resistance marker and faster selection; b) transformation of pyr4$^+$ strains (without the need to generate pyr4$^-$ prior to transformation); and c) removal of both markers from the transformants using 5-fluoroorotic acid (like in removal of standard pyr4 blaster cassette) and simultaneous mutagenization of the endogenous pyr4 resulting in marker-free, pyr4$^-$ strain.

The second deletion plasmid for the aspartic protease pep12 (tre1 19876), pTTv245, was constructed using the plasmid pTTv209 above as the backbone. The pyr4-bar double marker was removed from pTTv209 with NotI digestion. The new pyr4 marker gene was obtained from pTTv181 (Δpep4-pyr4 above) with NotI digestion. Cloning of the plasmid pTTv245 was done with standard ligation using T4 DNA ligase at room temperature. Part of the ligation mixture was transformed into *E. coli* with electroporation. A few clones were cultivated, plasmid DNA was isolated and digested to screen for correct ligation using standard laboratory methods. Correct ligation and orientation of the marker was further verified by sequencing.

1019 bp of 5' flanking region and 895 bp of 3' flanking region were selected as the basis of the pep12 deletion plasmids. A 300 bp stretch from the end of pep12 5' flank was used as the direct repeat fragment. These fragments were amplified by PCR using the primers listed in Table 14.3. The products were separated with agarose gel electrophoresis and the correct fragments were isolated from the gel with a gel extraction kit (Qiagen) using standard laboratory methods. The double marker (pyr4-bar) was digested from pTTv202 (Δpep5-pyr4-bar) with NotI. To enable removal of the complete double marker cassette, NotI restriction sites were introduced on both sides of the double marker cassette. AscI site was introduced between the pep12 5'direct repeat and 3' flank. Vector backbone was EcoRI/XhoI digested pRS426 as in Example 1. The plasmid pTTv209 was constructed using the yeast homologous recombination method described in Example 1. These deletion plasmids for pep12 (pTTv209 and pTTv245, Table 14.3) result in a 2198 bp deletion in the pep12 locus and cover the complete coding sequence of PEP 12.

TABLE 14.3

Primers for generating pep12 deletion plasmids.

| Primer | Sequence |
|---|---|
| Deletion plasmid pTTv209, (Δpep2-pyr4-bar), vector backbone pRS426 | |
| T477_pep12_5f_for | GGTAACGCCAGGGTTTTCCCAGTCACGACGGTTTAAAC (SEQ ID NO: ) CGACAGCACGTTGTGTGCTCC (SEQ ID NO: 618) |
| T478_pep12_5f_rev | GCGCTGGCAACGAGAGCAGAGCAGCAGTAGTCGATGCTAGGCGGCCGCTGGAGA CCCAGCAGCCAGCA (SEQ ID NO: 619) |
| 1479_pep12_DR_for | CCCGTCACCGAGATCTGATCCGTCACCGGGATCCACTTAAGCGGCCGCTCAGAG GGAGGCTGCCCAAC (SEQ ID NO: 620) |

TABLE 14.3-continued

Primers for generating pep12 deletion plasmids.

| Primer | Sequence |
|---|---|
| T480_pep12_DR_rev | GAGACTCGAACAAAGACATCTTTGCGACCTCGTCCACGGCGGCGCGCCTGGAGA CCCAGCAGCCAGCA (SEQ ID NO: 621) |
| T481_pep12_3f_for | GCCGTGGACGAGGTCGCAAA (SEQ ID NO: 622) |
| T482_pep12_3f_rev | AGCGGATAACAATTTCACACAGGAAACAGCGTTTAAACCCCTGCGCCCTCTTCT GCAC (SEQ ID NO: 623) |

Deletion plasmid pTTv245 (Δpep2-pyr4)

no new primers, pTTv209 digested with NotI and ligated with pyr4 fragment from pTTv181

Generation of 9-Fold Protease Deletion Strain with Pep12 (Tre1 19876); M575

To generate a marker-free 9-fold protease deletion strain, removal of the pyr4 marker was applied to the 8-fold deletion strain M504 (38-48A, pTTv229 in M496) essentially as described in Example 3 for removal of the pyr4 blaster cassette from the strain M195 {Δpep1). Consecutive 5-FOA selection steps were carried out to ensure that the clones selected were originating from single cells.

Final clones were verified by PCR using the primers listed in Table 14.4 with standard laboratory methods. Signal corresponding to successful removal of the blaster cassette was obtained for majority of the clones. Removal of the blaster cassette was further verified by plating the clones onto minimal medium plates with or without 5 mM uridine. No growth was observed on the plates without uridine supplementation. Resulting strain used in generation of Si-fold protease deletion strain was designated with strain number M521.

To remove vector sequence, plasmid pTTv245 (Δpep12-pyr4) was digested with MssI and the correct fragment purified from an agarose gel using a QIAquick Gel Extraction Kit (Qiagen). Approximately 5 μg of the deletion cassette was used to transform a clone of 8-fold protease deletion strain M521 (Δpep1Δtsp1Δslp1Δgap1Δgap2Δpep4Δpep3Δpep5, pyr4⁻). Preparation of protoplasts and transformation were carried out essentially as described in Example 1 for the strains M181 and M195 using pyr4 selection.

Transformants were picked as first streaks. Growing streaks were screened by PCR (using the primers listed in Table 14.4) for correct integration. Clones giving the expected signals were purified to single cell clones and rescreened by PCR using the primers listed in Table 14.4. Deletion of pep12 was verified by Southern analyses from selected clones (Data not shown) using methods described in Example 1. Clone 42-45B was designated with strain number M575.

TABLE 14.4

Primers for screening removal of pyr4 blaster cassette from 8-fold protease deletion strain and for screening of pTTv245/Δpep12-pyr4 integration and strain purity.

| Primer | Sequence |
|---|---|
| For screening removal of pyr4 blaster cassette from M504 and strain purity | |
| T858_pep5_5f_f3 | GGAATCGTCACCAAGGAG (SEQ ID NO: 625) |

TABLE 14.4-continued

Primers for screening removal of pyr4 blaster cassette from 8-fold protease deletion strain and for screening of pTTv245/Δpep12-pyr4 integration and strain purity.

| Primer | Sequence |
|---|---|
| T755_pep5_3f_rev3 | CTTCTGGTGACATTCCGAC (SEQ ID NO: 613) |
| T627_pep5_5int_new | GTCGAAGATGTCCTCGAGAT (SEQ ID NO: 432) |
| T488_pyr4_5utr_rev | GGAGTTGCTTTAATGTCGGG (SEQ ID NO: 433) |
| T860_pep5_orf_f3 | GTCGAGCGTCTGATATTCAC (SEQ ID NO: 439) |
| T861_pep5_orf_r2 | GACGGAGACCTCCCACA (SEQ ID NO: 440) |
| For screening integrations of pTTv245 (Δpep12-pyr4) | |
| T517_pep12_5int | AGCAGTCCACCTGCTCAAAA (SEQ ID NO: 626) |
| T026_Pyr4_orf_5rev2 | CCATGAGCTTGAACAGGTAA (SEQ ID NO: 446) |
| T061_pyr4_orf_screen_2F | TTAGGCGACCTCTTTTTCCA (SEQ ID NO: 382) |
| T518_pep12_3int | GATTCACACCAATGAGTCGG (SEQ ID NO: 627) |
| For screening deletion of pep12 (tre19876) ORF | |
| T486_pep 12_orf_probef | CCCCGACTTTGCCCCGTCAC (SEQ ID NO: 628) |
| T487_pep12_orf_prober | TCGTCAGAGTCGTCGCCCGT (SEQ ID NO: 629) |
| T1057_pep12_orf_probef2 | GCGCAGCTAATGTCCTCTGT (SEQ ID NO: 630) |
| T1058_pep12_orf_prober2 | TTGTTGAGCCAGAGTCGAGA (SEQ ID NO: 631) |

Example 15—Generation of 10-Fold Protease Deletion Strain

Generation of 10-Fold Protease Deletion Strain Having Deletions Δpep1Δtsp1Δslp1Δgap1Δgap2Δpep4Δpep3Δpep5Δpep2Δpep11

Generation of Pep 11 Deletion Plasmid

The deletion plasmid pTTv312 for the aspartic protease pep11 (tre121306) was constructed essentially as described for pep1 deletion plasmid pTTv41 in Example 1.

956 bp of 5' flanking region and 943 bp of 3' flanking region were selected as the basis of the pep11 deletion plasmid. A 307 bp stretch from the end of pep11 5' flank was used as the direct repeat fragment. These fragments were amplified by PCR using the primers listed in Table 15.1. The products were separated with agarose gel electrophoresis and the correct fragments were isolated from the gel with a gel extraction kit (Qiagen) using standard laboratory methods. The pyr4 cassette was obtained from pTTv181 (Δpep4-pyr4 above) with NotI digestion. To enable removal of the marker cassette, NotI restriction sites were introduced on both sides of the cassette. AscI site was introduced between the pep11 5'direct repeat and 3' flank. Vector backbone was EcoRI/XhoI digested pRS426 as in Example 1. The plasmid was constructed using the yeast homologous recombination method described in Example 1. This deletion plasmid for pep11 (pTTv312, Table 15.1) results in 2624 bp deletion in the pep11 locus and covers the complete coding sequence of PEP11.

blaster cassette from the strain M195 (Δpep1). Consecutive 5-FOA selection steps were carried out to ensure that the clones selected were originating from single cells.

Final clones were verified by PCR using the primers listed in Table 15.2 with standard laboratory methods. Signal corresponding to successful removal of the blaster cassette was obtained for majority of the clones. Removal of the blaster cassette was further verified by plating the clones onto minimal medium plates with or without 5 mM uridine. No growth was observed on the plates without uridine supplementation. Resulting strain used in generation of 10-fold protease deletion strain was designated with strain number M597.

To remove vector sequence, plasmid pTTv312 (Δpep11-pyr4) was digested with MssI and the correct fragment purified from an agarose gel using a QIAquick Gel Extraction Kit (Qiagen). Approximately 5 μg of the deletion cassette was used to transform a clone of 9-fold protease deletion strain M597 (Δpep1Δtsp1Δslp1Δgap1Δgap2Δpep4Δpep3Δpep5Δpep2, pyr4⁻). Preparation of protoplasts and transformation were carried out essentially as described in Example 1 for the strains M181 and M195 using pyr4 selection.

Transformants were picked as first streaks. Growing streaks were screened by PCR (using the primers listed in Table 15.2) for correct integration. Clones giving the expected signals were purified to single cell clones and rescreened by PCR using the primers listed in Table 15.2.

TABLE 15.1

Primers for generating pep11 deletion plasmids. Deletion plasmid pTTv312, (Δpep11-pyr4), vector backbone pRS426

| Primer | Sequence |
| --- | --- |
| T1009_pep11_5flkfw_vector | GTAACGCCAGGGTTTTCCCAGTCACGACGGTTTAAACATGAGCGTG ATCGACAAGTG (SEQ ID NO: 632) |
| T1010_pep11_5flkrev_pyr4Prom | GCGCTGGCAACGAGAGCAGAGCAGCAGTAGTCGATGCTAGGCGGCC GCCCTCTGAGGTCGAGATGGAG (SEQ ID NO: 633) |
| T1144_pep11_5dr_for | TGATTGTACCCCAGCTGCGATTGATGTGTATCTTTGCATGGCGGCC GCACGACTAATATCCACTGCCG (SEQ ID NO: 634) |
| T1 145_pep11_5dr_rev | AACCAAAGTGTACAATGCTCATCTCGTATTCACATGCAAAGGCGCG CCCCTCTGAGGTCGAGATGGAG (SEQ ID NO: 635) |
| T1 146_pep11_3f_for | TTTGCATGTGAATACGAGATGA (SEQ ID NO: 636) |
| T1012_pep11_3flkrev_vector | GCGGATAACAATTTCACACAGGAAACAGCGTTTAAACTGCTCGATC CTACTCCAAGG (SEQ ID NO: 637) |

Generation of 10-Fold Protease Deletion Strain with Pep11 (Tre121306); M658

To generate a marker-free 10-fold protease deletion strain, removal of the pyr4 marker was applied to the 9-fold deletion strain M574 (41-45G, pTTv246 in M521) essentially as described in Example 3 for removal of the pyr4

Deletion of pep11 was verified by Southern analyses from selected clones (data not shown) using methods described in Example 1. Clone 47-62B was designated with strain number M632. An additional single cell purification step was applied to strain M632 to obtain 10-fold protease deletion strain M658.

TABLE 15.2

Primers for screening removal of pyr4 blaster cassette from 9-fold protease deletion strain and for screening of pTTv312/Δpep11-pyr4 integration and strain purity.

| Primer | Sequence |
| --- | --- |
| *For screening removal of pyr4 blaster cassette from M574 and strain purity* | |
| T1162_pep2_5f_f2 | CTGTAAAGGCAGCATCGG (SEQ ID NO: 640) |
| T1163_pep2_3f_r2 | TCAGAACGGCTTCAATCATT (SEQ ID NO: 639) |
| T1162_pep2_5f_f2 | CTGTAAAGGCAGCATCGG (SEQ ID NO: 638) |
| T488_pyr4_5utr_rev | GGAGTTGCTTTAATGTCGGG (SEQ ID NO: 428) |
| T601_pep2_fwd | GACGTGGTACGACAACATCG (SEQ ID NO: 269) |
| T623_pep2_rev | TATCAAGGTACCGGGGACAG (SEQ ID NO: 270) |
| *For screening integrations of pTTv312 (Δpep11-pyr4)* | |
| T1013_pep11_screen_5flk_fwd | TTACGACTCGATCCCTGTCC (SEQ ID NO: 641) |
| T488_pyr4_5utr_rev | GGAGTTGCTTTAATGTCGGG (SEQ ID NO: 433) |
| T061_pyr4_orf_screen_2F | TTAGGCGACCTCTTTTTCCA (SEQ ID NO: 434) |
| T1016_pep11_screen_3flk_rev | GCCGCTAGGATCGTGATAAG (SEQ ID NO: 642) |
| *For screening deletion of pep11 ORF* | |
| T1017_pep11_orf_fwd | GTGTCCCAGGACGACAACTT (SEQ ID NO: 643) |
| T1018_pep11_orf_rev | TGAAGGTTGCAGTGATCTCG (SEQ ID NO: 644) |

Example 16—Generation of TPPI Deletion Plasmid

The deletion plasmid pTTv331 for tripeptidyl peptidase tpp1 (tre82623) was constructed essentially as described for pep1 deletion plasmid pTTv41 in Example 1, except that the marker used for selection was a double marker pyr4-hph.

1245 bp of 5' flanking region and 1025 bp of 3' flanking region were selected as the basis of the tpp1 deletion plasmid. A 311 bp stretch from the end of tpp1 5' flank was used as the direct repeat fragment. These fragments were amplified by PCR using the primers listed in Table 16.1. The products were separated with agarose gel electrophoresis and the correct fragments were isolated from the gel with a gel extraction kit (Qiagen) using standard laboratory methods. The pyr4-hph cassette was obtained from pTTv210 (AsepI-pyr4-hph) with NotI digestion. To enable removal of the complete double marker cassette, NotI restriction sites were introduced on both sides of the double marker cassette. AscI site was introduced between the tpp1 5'direct repeat and 3' flank. Vector backbone was EcoRI/XhoI digested pRS426 as in Example 1. The plasmid was constructed using the yeast homologous recombination method described in Example 1. This deletion plasmid for tpp1 (pTTv331, Table 16.1) results in 2152 bp deletion in the tpp1 locus and covers the complete coding sequence of TPP1.

TABLE 16.1

Primers for generating tpp1 deletion plasmid. Deletion plasmid pTTv331, (Δtpp1-pyr4-hph), vector backbone pRS426

| Primer | Sequence |
| --- | --- |
| T311_82623_5for | GTAACGCCAGGGTTTTCCCAGTCACGACGGTTTAAACCGCATTACG AATGCACAAAG (SEQ ID NO: 645) |
| T1190_tpp1_5f_rev2 | GCGCTGGCAACGAGAGCAGAGCAGCAGTAGTCGATGCTAGGCGGCC GCCCATGTCAGCTCAGACCAAT (SEQ ID NO: 646) |
| T1191_tpp1_5dr_for | GTACACTTGTTTAGAGGTAATCCTTCTTTCTAGAAGGAGAGCGGCC GCAGGCCCTGGACTGCTAGTTT (SEQ ID NO: 647) |
| T1192_tpp1_5dr_rev | CGAGCCATCCGCCGCGGCCCTATATTCCACCCGAGTCCTCGGCGCG CCCCATGTCAGCTCAGACCAAT (SEQ ID NO: 648) |
| T1193_tpp1_3f_for2 | GAGGACTCGGGTGGAATATAGG (SEQ ID NO: 649) |
| T314_82623_3rev | GCGGATAACAATTTCACACAGGAAACAGCGTTTAAACTTGGTCTTG AATGAAAGGTGTG (SEQ ID NO: 650) |

Example 17—Generation of PEP8 Deletion Plasmids

Another deletion plasmid pTTv319 for aspartic protease pep8 (tre1 22076) was constructed essentially as described for pep1 deletion plasmid pTTv41 in Example 1.

The second deletion plasmid for the aspartic protease pep8 (tre122076), pTTv328, was constructed using the plasmid pTTv319 above as the backbone. The pyr4 marker was removed from pTTv319 with NotI digestion. The pyr4-hph cassette was obtained from pTTv210 (ΔsepI-pyr4-hph) with NotI digestion. Cloning of the plasmid pTTv328 was done with standard ligation using T4 DNA ligase at room temperature. Part of the ligation mixture was transformed into E. coli with electroporation. A few clones were cultivated, plasmid DNA was isolated and digested to screen for correct ligation using standard laboratory methods. Correct ligation and orientation of the marker was further verified by sequencing.

1095 bp of 5' flanking region and 988 bp of 3' flanking region were selected as the basis of the pep8 deletion plasmids. A 324 bp stretch from the end of pep8 5' flank was used as the direct repeat fragment. These fragments were amplified by PCR using the primers listed in Table 17.1. The products were separated with agarose gel electrophoresis and the correct fragments were isolated from the gel with a gel extraction kit (Qiagen) using standard laboratory methods. The pyr4 selection marker used in pTTv319 was obtained from pTTv181 (Δpep4-pyr4 above) with NotI digestion. To enable removal of the pyr4 marker cassette, NotI restriction sites were introduced on both sides of the cassette. AscI site was introduced between the pep8 5'direct repeat and 3' flank. Vector backbone was EcoRI/XhoI digested pRS426 as in Example 1. The plasmid pTTv319 was constructed using the yeast homologous recombination method described in Example 1. These deletion plasmids for pep8 (pTTv319 and pTTv328, Table 17.1) result in a 1543 bp deletion in the pep8 locus and cover the complete coding sequence of PEP5.

TABLE 17.1

Primers for generating pep8 deletion plasmids.

| Primer | Sequence |
|---|---|
| Deletion plasmid pTTv319, (Δpep8-pyr4), vector backbone pRS426 | |
| T1019_pep8_5flkfw_vector | GTAACGCCAGGGTTTTCCCAGTCACGACGGTTTAAACAGGTTTGGGTT GTGAGATCG (SEQ ID NO: 651) |
| T1020_pep8_5flkrev_pyr4Prom | GCGCTGGCAACGAGAGCAGAGCAGCAGTAGTCGATGCTAGGCGGCCGC GCGCAAAGCTACTGGGCTAT (SEQ ID NO: 652) |
| T1167_pep8_5DR_for | TGATTGTACCCCAGCTGCGATTGATGTGTATCTTTGCATGGCGGCCGC TCTGCTCTGCTCTGTTCTGC (SEQ ID NO: 653) |
| T1168_pep8_5DR_rev | AAAGTTCGTCAAAGAGCACTCATAGGGCTGAGAAAAGCCAGGCGCGCC GCGCAAAGCTACTGGGCTAT (SEQ ID NO: 654) |
| T1169_pep8_3f_for2 | TGGCTTTTCTCAGCCCTATG (SEQ ID NO: 655) |
| T1022_pep8_3flkrev_vector | GCGGATAACAATTTCACACAGGAAACAGCGTTTAAACCAATGTGTGCC TGTTTTTCG (SEQ ID NO: 656) |
| Deletion plasmid pTTv328 ((Δpep8-pyr4-hph) | |
| no new primers, pTTv319 digested with NotI and ligated with pyr4-hph fragment from pTTv210 | |

The third deletion plasmid pTTv266 for aspartic protease pep8 (tre1 22076) was constructed essentially as described for pep1 deletion plasmid pTTv41 in Example 1, except that the marker used for selection was pyr4-hgh from pTTv194.

1095 bp of 5' flanking region and 988 bp of 3' flanking region were selected as the basis of the pep8 deletion plasmid pTTv266. These fragments were amplified by PCR using the primers listed in Table 17.2. The products were separated with agarose gel electrophoresis and the correct fragments were isolated from the gel with a gel extraction kit (Qiagen) using standard laboratory methods. The pyr4-hgh selection marker used in pTTv266 was obtained from pTTv194 (Δpep4-pyr-hgh above) with NotI digestion. To enable removal of the pyr4-hgh marker cassette, NotI restriction sites were introduced on both sides of the cassette. Vector backbone was EcoRI/XhoI digested pRS426 as in Example 1. The plasmid pTTv266 was constructed with the 5' flank, 3' flank, pyr4-hgh marker, and vector backbone using the yeast homologous recombination method described in Example 1. The deletion plasmids for pep8 (pTTv266, Table 17.2) result in a 1543 bp deletion in the pep8 locus and cover the complete coding sequence of PEP8.

TABLE 17.2

Primers for generating pep8 deletion plasmids.
Deletion plasmid pTTv266, (Δpep8-pyr4-hgh), vector backbone pRS426

| Primer | Sequence |
| --- | --- |
| T1019_pep8_5flkfw_vector | GTAACGCCAGGGTTTTCCCAGTCACGACGGTTTAAACAGGTTTGGGTT GTGAGATCG (SEQ ID NO: 657) |
| T1020_pep8_5flkrev_pyr4Prom | GCGCTGGCAACGAGAGCAGAGCAGCAGTAGTCGATGCTAGGCGGCCGC GCGCAAAGCTACTGGGCTAT (SEQ ID NO: 658) |
| T1021_pep8_3flkfw_pyr4loop | CAACCAGCCGCAGCCTCAGCCTCTCTCAGCCTCATCAGCCGCGGCCGC TGGCTTTTCTCAGCCCTATG (SEQ ID NO: 659) |
| T1022_pep8_3flkrev_vector | GCGGATAACAATTTCACACAGGAAACAGCGTTTAAACCAATGTGTGCC TGTTTTTCG (SEQ ID NO: 660) |

Example 18—Generation of Protease Deletions in the Interferon Producing Strains

Generation of IFN-α2b Producing 5-Fold Protease Deletion Strain

To generate the IFN-α 2b producing strain for the five fold protease deletion strain, the Δpep1Δtsp1Δslp1Δgap1Δgap2 five fold protease deletion strain M369 was transformed with IFN-α 2b expression cassette (pTTv173) using hygromycin in selection. This IFN-α 2b strain with Δpep1Δtsp1Δslp1Δgap1Δgap2 five fold protease deletions was designated with number M401.

Analysis of IFN-α 2b Producing 5-Fold Protease Deletion Strain M401

Figure 54A:
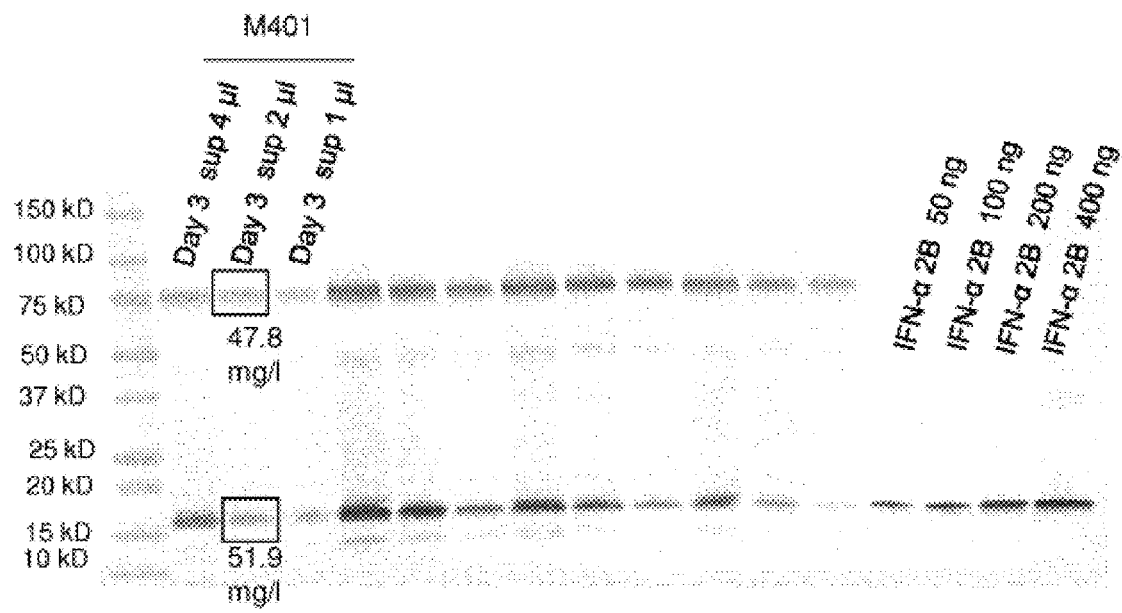
FIG. 54A depicts quantification of the IFN-α 2b expression level from the day 3 sample of M401 fermentation. 1 μl/2 μl/4 μl of supernatant were loaded to a 4-20% SDS PAGE gel. Immunoblotting was done with Abcam (#ab9386) anti-IFN-α 2b antibody diluted to 1 μg/ml in TBST. The secondary antibody from Bio-rad (#170-6520) goat anti-mouse IgG AP conjugated secondary antibody diluted 1:5000 in TBST. The protein standards were loaded on the gel corresponding 50 ng, 100 ng and 200 ng of full length IFN-α 2b. Densitometric quantification was done with Totallab Quant TL100 software. For the quantification 2 μg/ml sample was most representative. Full length IFN-α 2b control (100 ng) runs at 19.3 kD and carrier bound IFN-α 2b at 70 kDa.

To study the expression level of IFN-α 2b, the 5-fold protease deletion (Δpep1Δtsp1Δslp1Δgap1Δgap2) IFN-α 2b producing strain M401 was cultured in culture conditions pH 4,5; 28→22° C.; 30 g/l glucose, 60 g/l lactose, 20 g/l whole spent grain, and 20 g/l spent grain extract. To analyze the expression level of IFN-α 2b, day 3 culture sample was subjected to quantitative immunoblotting (FIG. 54A). The samples were analysed by comparison to IFN-α 2b standard curve and the densitometric quantification was done with Totallab Quant TL100 software. Immunoblotting was done with Abeam (#ab9386) anti-IFN-α 2b antibody diluted to 1 μm/ml in TBST. The secondary antibody from Bio-rad (#170-6520) goat anti-mouse IgG AP conjugated secondary antibody diluted 1:5000 in TBST. The protein standards were loaded to the gel corresponding 50 ng, 100 ng, 200 ng and 400 ng of IFN-α 2b. The analysis showed that M401 produced IFN-α 2b at yields of up to 51.9 mg/l and 52% of the product was cleaved from the carrier molecule.

Generation of IFN-α 2b Producing 8-Fold Protease Deletion Strain M577

To generate the IFN-α 2b producing strain for the eight fold protease deletion strain, the Δpep1Δtsp1 Δslp1 Δgap1Δgap2Δpep4Δpep3Δpep5 eight fold protease deletion strain M504 was transformed with IFN-α 2b expression cassette (pTTv254) using acetamide in selection. This IFN-α 2b strain with Δpep1Δtsp1 Δslp1 Δgap1Δgap2Δpep4Δpep3Δpep5 eight fold protease deletions was designated with number M577.

Analysis of IFN-α2b Producing 8-Fold Protease Deletion Strain M577

Figure 54B:
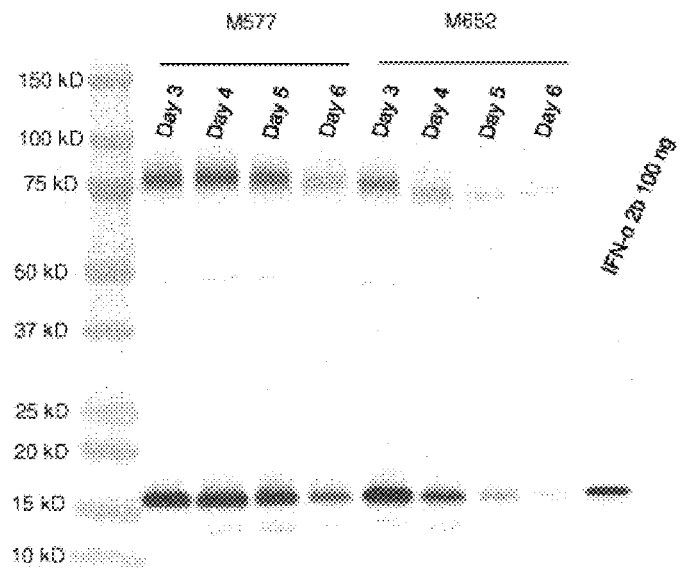
FIG. 54B depicts immunoblot analysis for day 3-6 samples of M577 and M652 fermentation cultures. 0.2 μl of growth supernatant was loaded to a 4-20% SDS PAGE gel. Immunoblotting was done with Abcam (#ab9386) anti-IFN-α 2b antibody diluted to 1 μg/ml in TBST. The secondary antibody from Bio-rad (#170-6520) goat anti-mouse IgG AP conjugated secondary antibody diluted 1:5000 in TBST. Full length IFN-α 2b control (100 ng) runs at 19.3 kD and carrier bound IFN-α 2b at 70 kDa.
Figure 55:
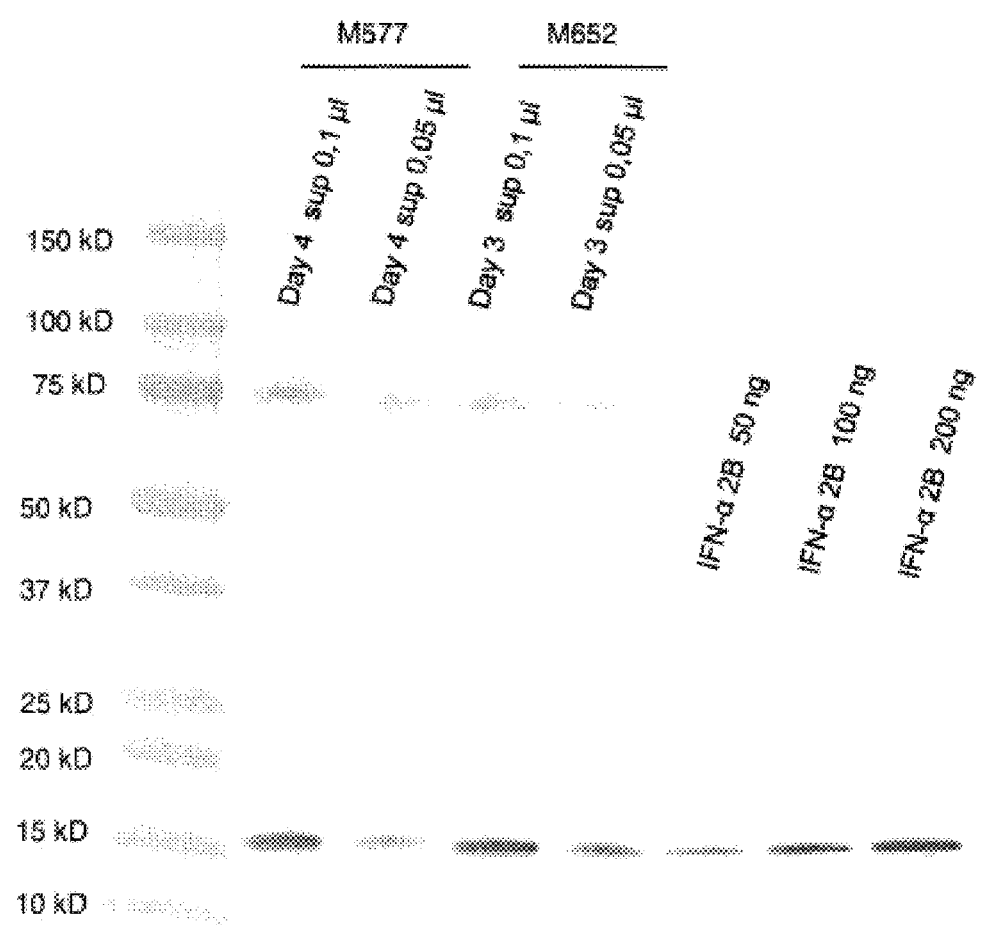
FIG. 55 depicts quantification of the IFN-α 2b expression level from the day 4 (M577 fermentation) and day 3 (M652 fermentation) samples. 0.05 μl and 0.1 μl of supernatant were loaded of each sample to a 4-20% SDS PAGE gel.

To study the expression level of IFN-α 2b, the 8-fold protease deletion (Δpep1Δtsp1 Δslp1Δgap1Δgap2Δpep4Δpep3Δpep5) IFN-α 2b producing strain M577 was cultured in the conditions pH 4,5; 28→22° C.; 2% yeast extract, 4% cellulose, 8% cellobiose and 4% sorbose. To study the expression of IFN-α 2b, M577 fermentation samples were subjected to immunoblotting (FIG. 54B). To analyse the expression level of IFN-α 2b, day 4 culture sample was subjected to quantitative immunoblotting (FIG. 55). The sample was analysed by comparison to IFN-α 2b standard curve and the densitometric quantification was done with Totallab Quant TL100 software. Immunoblotting was done with Abeam (#ab9386) anti-IFN-α 2b antibody diluted to 1 μg/ml in TBST. The secondary antibody from Bio-rad (#170-6520) goat anti-mouse IgG AP conjugated secondary antibody diluted 1:5000 in TBST. The protein standards were loaded to the gel corresponding 50 ng, 100 ng and 200 ng of IFN-α 2b. The analysis showed that M577 produced IFN-α 2b at yields of up to 1780 mg/l and 66.5% of the product was cleaved from the carrier molecule. The 8-fold protease deletion strain M577 produced 34 times more IFN-α 2b than 5-fold protease deletion strain M401.

Generation of IFN-α 2b Producing 9-Fold Protease Deletion Strain M652

To generate the IFN-α 2b producing strain for the nine fold protease deletion strain, the Δpep1Δtsp1Δslp1Δgap1Δgap2Δpep4Δpep3Δpep5 Δpep2 nine fold protease deletion strain M574 was transformed with IFN-α 2b expression cassette (pTTv173) using hygromycin in selection. This IFN-α 2b strain with Δpep1Δtsp1Δslp1Δgap1Δgap2Δpep4Δpep3Δpep5Δpep2 nine fold protease deletions was designated with number M652.

Analysis of IFN-α 2b Producing 9-Fold Protease Deletion Strain M652

To study the expression level of IFN-α 2b, the 8-fold protease deletion (Δpep1Δtsp1Δslp1Δgap1Δgap2Δpep4Δpep3Δpep5Δpep2) IFN-α 2b producing strain M652 was cultured in the conditions pH 4,5; 28→22° C.; 2% yeast extract, 4% cellulose, 8% cellobiose and 4% sorbose. To study the expression of IFN-α 2b, M652 fermentation samples were subjected to immunoblotting (FIG. 54B). To analyse the expression level of IFN-α 2b, day 3 culture sample was subjected to quantitative immunoblotting (FIG. 55). The sample was analysed by comparison to IFN-α 2b standard curve and the densitometric quantification was done with Totallab Quant TL100 software. Immunoblotting was done with Abeam (#ab9386) anti-IFN-α 2b antibody diluted to 1 μg/ml in TBST. The secondary antibody from Bio-rad (#170-6520) goat anti-mouse IgG AP conjugated secondary antibody diluted 1:5000 in TBST. The protein standards were loaded on the gel corresponding 50 ng, 100 ng and 200 ng of IFN-α 2b. The analysis showed that M652 produced IFN-α 2b at yields of up to 1928 mg/l and 85% of the product was cleaved from the carrier molecule. The 9-fold protease deletion strain M652 produced slightly more than 8-fold protease deletion M577 and 37 times more IFN-α 2b than 5-fold protease deletion strain M401.

Generation of 9-Fold Protease Deletion Strain M670 with Pep8 (Tre122076) Deleted from the Interferon Production Strain M577

To remove the deletion cassette, plasmid pTTv266 (Δpep8-pyr4-hgh) was digested with PmeI and the correct fragment was purified using a QIAquick Gel Extraction Kit (Qiagen). Approximately 5 μg of the deletion cassette was used to transform the 8-fold protease deletion strain M577 (Δpep1Δtsp1Δslp1Δgap1Δgap2Δpep4Δpep3Δpep5). The M577 strain produces interferon alpha 2b. Preparation of protoplasts and transformation were carried out essentially as described in Example 1 using hygromycin selection.

Transformants were picked and streaked on selection plates. Growing streaks were screened by PCR (using the primers listed in Table 18.1) for correct integration. Clones giving the expected signals were purified to single cell clones and rescreened by PCR using the primers listed in Table 18.1. Clone 82-9 was designated with strain number M670.

TABLE 18.1

Primers for screening pTTv266/Δpep8-pyr4-hgh integration and strain purity.

| Primer | Sequence |
| --- | --- |
| Deletion plasmid pTTv266, (Δpep8-pyr4-hgh) | |
| T1023_pep8_screen_5flk_fwd | TTTATCCGCTTCCACGACAC (SEQ ID NO: 661) |
| T 1084_screen_5flk_pyr_rev | TCTTGAGCACGACAATCGAC (SEQ ID NO: 662) |
| T 1015_screen_3flk_hygro_fwd | GCATGGTTGCCTAGTGAATG (SEQ ID NO: 663) |
| T1024_pep8_screen_3flk_rev | CGATGGTGAAGTCAATGTGG (SEQ ID NO: 664) |
| For screening deletion of pep8 ORF | |
| T1025_pep8_orf_fwd | GGCGATTACTTCCAGGACAA (SEQ ID NO: 665) |
| T1026_pep8_orf_rev | CAATGGCAATCTGGTTGTTG (SEQ ID NO: 666) |

Generation of Pep11 Deletion Plasmid

The deletion plasmid pTTv268 for the aspartic protease pep11 (tre121306) was constructed essentially as described for pep1 deletion plasmid pTTv41 in Example 1, except that the marker used for selection was pyr4-hgh from pTTv194.

956 bp of 5' flanking region and 957 bp of 3' flanking region were selected as the basis of the pep11 deletion plasmid pTTv268. These fragments were amplified by PCR using the primers listed in Table 18.2. The products were separated with agarose gel electrophoresis and the correct fragments were isolated from the gel with a gel extraction kit (Qiagen) using standard laboratory methods. The pyr4-hgh cassette was obtained from pTTv194 (Δpep4-pyr-hgh) with NoiI digestion. To enable removal of the marker cassette, NoiI restriction sites were introduced on both sides of the cassette. Vector backbone was EcoRI/XhoI digested pRS426 as in Example 1. The plasmid was constructed. The plasmid pTTv268 was constructed with the 5' flank, 3' flank, pyr4-hgh marker, and vector backbone using the yeast homologous recombination method described in Example 1. This deletion plasmid for pep11 (pTTv268, Table 18.2) results in a deletion in the pep11 locus and covers the complete coding sequence of PEP11.

TABLE 18.2

Primers for generating pep11 deletion plasmids Deletion plasmid pTTv268 (Δpep11-pyr4-hgh), vector backbone pRS426

| Primer | Sequence |
| --- | --- |
| T1009_pep11_5flkfw_vector | GTAACGCCAGGGTTTTC CCAGTCACGACGGTTTA AACATGAGCGTGATCGA CAAGTG (SEQ ID NO: 667) |
| T1010_pep11_5flkrev_pyr4Prom | GCGCTGGCAACGAGAG CAGAGCAGCAGTAGTC GATGCTAGGCGGCCGC CCTCTGAGGTCGAGAT GGAG (SEQ ID NO: 668) |
| T101 1_pep11_3flkfw_pyr4loop | CAACCAGCCGCAGCCT CAGCCTCTCTCAGCCT CATCAGCCGCGGCCGC TTTGCATGTGAATACG AGATGA (SEQ ID NO: 669) |
| T1012_pep11_3flkrev_vector | GCGGATAACAATTTCAC ACAGGAAACAGCGTTTA AACTGCTCGATCCTACT CCAAGG (SEQ ID NO: 670) |

Generation of 9-Fold Protease Deletion Strain M672 with Pep11 (Tre121306) Deleted from the Interferon Production Strain M577

To remove the deletion cassette, plasmid pTTv268 (Δpep11-pyr4-hgh) was digested with PmeI and the correct fragment was purified using a QIAquick Gel Extraction Kit (Qiagen). Approximately 5 μg of the deletion cassette was used to transform the 8-fold protease deletion strain M577 (Δpep1Δtsp1Δslp1Δgap1Δgap2Δpep4Δpep3Δpep5). The M577 strain produces interferon alpha 2b. Preparation of protoplasts and transformation were carried out essentially as described in Example 1 using hygromycin selection.

Transformants were picked and streaked on selection plates. Growing streaks were screened by PCR (using the primers listed in Table 18.3) for correct integration. Clones giving the expected signals were purified to single cell clones and rescreened by PCR using the primers listed in Table 18.3. Clone 33-9 was designated with strain number M672.

TABLE 18.3

Primers for screening pTTv268/Δpep11-pyr4-hgh integration and strain purity.

| Primer | Sequence |
| --- | --- |
| Deletion plasmid pTTv268, (Δpep11-pyr4-hgh) | |
| T1013_pep11_screen_5flk_fwd | TTACGACTCGATCCCTGTCC (SEQ ID NO: 671) |
| T1084_screen_5flk_pyr_rev | TCTTGAGCACGACAATCGAC (SEQ ID NO: 672) |

TABLE 18.3-continued

Primers for screening pTTv268/Δpep11-pyr4-hgh integration and strain purity.

| Primer | Sequence |
|---|---|
| T 1015_screen_3flk_hygro_fwd | GCATGGTTGCCTAGTGAATG (SEQ ID NO: 673) |
| T1016_pep11_screen_3flk_rev | GCCGCTAGGATCGTGATAAG (SEQ ID NO: 674) |
| For screening deletion of pep11 ORF | |
| T1017_pep1 1_orf_fwd | GTGTCCCAGGACGACAACTT (SEQ ID NO: 675) |
| T1018_pep 11 _orf_rev | TGAAGGTTGCAGTGATCTCG (SEQ ID NO: 676) |

Generation of 9-Fold Protease Deletion Strain M673 with Slp7 (Tre123865) Deleted from the Interferon Production Strain M577

To remove the deletion cassette, plasmid pTTv269 (Δslp7-pyr4-hgh) was digested with PmeI and the correct fragment was purified using a QIAquick Gel Extraction Kit (Qiagen). Approximately 5 μg of the deletion cassette was used to transform the 8-fold protease deletion strain M577 (Δpep1Δtsp1Δslp1Δgap1Δgap2Δpep4Δpep3Δpep5). The M577 strain produces interferon alpha 2b. Preparation of protoplasts and transformation were carried out essentially as described in Example 1 using hygromycin selection.

Transformants were picked and streaked on selection plates. Growing streaks were screened by PCR (using the primers listed in Table 18.4) for correct integration. Clones giving the expected signals were purified to single cell clones and rescreened by PCR using the primers listed in Table 18.4. Clone 5-64 was designated with strain number M673.

TABLE 18.4

Primers for screening pTTv269/Δslp7-pyr4-hgh integration and strain purity.

| Primer | Sequence |
|---|---|
| Deletion plasmid pTTv269, (Δslp7-pyr4-hgh) | |
| T1092_slp7_screen_5flk_fwd | TTGGTTTGAACAGCTGCAAG (SEQ ID NO: 677) |
| T 1084_screen_5flk_pyr_rev | TCTTGAGCACGACAATCGAC (SEQ ID NO: 678) |
| T1015_screen_3flk_hygro_fwd | GCATGGTTGCCTAGTGAATG (SEQ ID NO: 679) |
| T 1093_slp7_screen_3flk_rev | ATGGTCAGCCAGAACCTGAC (SEQ ID NO: 680) |
| For screening deletion of slp7 ORF | |
| T1094_slp7_orf_fwd | TCTTGAGCCGTTTCTCGAAT (SEQ ID NO: 681) |
| T1095_slp7_orf_rev | CCGCTCTTAGATCGATGGTC (SEQ ID NO: 682) |

Example 19—Generation of go Producing Strains M627 and M629

Vectors pTTg156 and pTTg173 were constructed by adding the double selection marker cassette (Hygromycin resistance marker gene (hph) between pki1 promoter and cbh2 terminator in addition to pyr4 expression cassette) to intermediate vectors pTTg145 and pTTg146. Intermediates were constructed by yeast recombination cloning, marker cassettes were added by conventional cloning by NotI digestion and ligation.

The generation strategy of fragments for intermediate vectors is presented on Table 19.1 below. Primers used for fragment generation are listed on Table 19.2 below. Once the fragments for pTTg145 and pTTg146 were constructed according to plan on Table 19.1, they were electroporated to yeast Saccharomyces cerevisiae FY834 for plasmid assembly by homologous recombination. Yeast cells were plated to SC-ura for 2-3 days cultivation in +30° C. Colonies were then pooled from the plates and plasmid pool was purified with Phenol/Chloroform extraction method. Plasmid pool was transformed to competent E. coli cells by electroporation. Electroporated cells were plated to LB+amp selection plates, cultivated+37° C. over night and colonies were screened by PCR. Positive colonies were then streaked to fresh plates as pure cultures, single colonies were cultured in liquid LB+amp media and potential intermediate vectors pTTg145 and pTTg146 were purified according to standard protocols. Plasmids were analyzed by restriction analysis and sequences were verified by sequencing.

Marker cassette was then added to vectors by conventional NotI digestion from pTTg163 and ligation into NotI linearized intermediates pTTg145 and pTTg146.

TABLE 19.1

Construction strategy of intermediate vectors pTTgl45-pTTgl49. The pTTvl41 and pTTvll are described in International Patent Application No. PCT/EP2011/070956. The plasmids pTTgl24 and pTTv225 were used for construction of fragments specified in table below.

| Vector code | Fragment 1 | Fragment 2 | Fragment 3 | Fragment 4 |
|---|---|---|---|---|
| pTTg145 (intermediate for pTTg156) | pTTv141 cut with NotI | PCR product from pTTg124 template GP364, GP334 >pCDNA promoter sequence and overlap to GnTI | PTTv11 cut with SacII/NdeI | PCR product from PTTv11 template GP342, GP358 |

TABLE 19.1-continued

Construction strategy of intermediate vectors pTTgl45-pTTgl49. The pTTvl41 and pTTvll are described in International Patent Application No. PCT/EP2011/070956. The plasmids pTTgl24 and pTTv225 were used for construction of fragments specified in table below.

| Vector code | Fragment 1 | Fragment 2 | Fragment 3 | Fragment 4 |
|---|---|---|---|---|
| pTTg146 (intermediate for pTTg173) | pTTv141 cut with NotI | PCR product from pTTv225 template GP395, GP334 >pCDNA promoter sequence with Kre2 leader and overlap to GnTI | PCR product from pTTv11 template GP340, GP336 | n/a |

TABLE 19.2

Primers used in construction of intermediate vectors pTT145-pTTg149.

| Code | Sequence 5' > 3' |
|---|---|
| GP364 | TCTCCACTCGACCTGCAGGCATGCGCGATCGCGCGGCCGAA TTCGGTCTGAAGGACGTGG (SEQ ID NO: 683) |
| GP334 | TGGCGCCCCACAGCACAAGCCCTGCAGACTGCTTCTTCAGC ATGTTGAGAGAAGTTGTTGG (SEQ ID NO: 684) |
| GP395 | CATCTCCACTCGACCTGCAGGCATGCGCGATCGCGCGGCCG AATTCGGTCTGAAGGACGTGG (SEQ ID NO: 685) |
| GP340 | GGGGATGCCCTGTCGAGCCAGCGGGGGAGGGTGCCCACCGC CGCCCCTCCCGCCCAGCCG (SEQ ID NO: 686) |
| GP336 | GAAGGTGGTTTTTGCCTGTATAAGCCAGCCATCCGGCATAC TGCCCGCGGCCGCCCTGCAGTGCAGGATCTGC (SEQ ID NO: 687) |
| GP342 | TGGCGCCCCCACCGACGTGGGAGGGCTATGATCCCAGCTGG AATTAGCATATGATTAATTAAGG (SEQ ID NO: 688) |
| GP358 | GGTTTTTGCCTGTATAAGCCAGCCATCCGGCATACTGCCCG CGGCCGCAGTGCAGGATCTGC (SEQ ID NO: 689) |

*Trichoderma reesei* MAB01 expression strain M507 with 7-fold protease deletion was transformed with the PmeI fragments of pTTg156 and pTTg173 targeted to alg3 locus. Variable amount of transformants (100-170 depending on the construct) were picked onto selective plates. On the basis of PCR screening with Phire Plant Direct PCR kit (Finnzymes F-130), clones with positive results concerning 5'- and 3'-integration were selected for single spore platings and re-screening for integration and alg3 deletion (5 clones from pTTg156 trasformation, 3 clones from pTTg173 transformation). Primers used for screening are listed on Table 19.3 below.

PCR-screened strains were finally subjected to shake flask cultivation and glycan analysis. Final strains were named as M629 (pTTg173 transformant) and M627 (pTTg156 transformant).

TABLE 19.3

Primers used for screening alg3 integration in M507 pTTg156 and pTTg173.

| Code | Description | Sequence 5' > 3' |
|---|---|---|
| GP488 | alg3 5' integration screen Forward outside the flank | GATGTTGCGCCTGGGTTGAC (SEQ ID NO: 690) |

TABLE 19.3-continued

Primers used for screening alg3 integration in M507 pTTg156 and pTTg173.

| Code | Description | Sequence 5' > 3' |
|---|---|---|
| GP495 | alg3 5' integration screen Reverse from pGPDA | CTTCTTATTGATTTGAGCC (SEQ ID NO: 691) |
| GP490 | alg3 3' integration screen Reverse outside the flank | GATTGTCATGGTGTACGTGA (SEQ ID NO: 692) |
| GP497 | alg3 3' integration screen Forward from cbhII terminator | GAGCCGCATCGCATAG (SEQ ID NO: 693) |
| GP491 | alg3 orf, forward (1492 bp product) | GCGTCACTCATCAAAACTGC (SEQ ID NO: 694) |
| GP492 | alg3 orf, reverse (1492 bp product) | CTTCGGCTTCGATGTTTCA (SEQ ID NO: 695) |

WSG Fermentation of Strains M627 and M629 and Glycan Analysis

*T. reesei* strains M627 and M629 were fermented in 4% WSG, 2% glucose, 4% cellobiose, 6% lactose, pH 5.5, and sampling was performed at days 3-6. The antibody titers are shown in Table 19.4.

For N-glycan analysis MAB01 was purified from culture supernatants using Protein G HP MultiTrap 96-well filter plate (GE Healthcare) according to manufacturer's instructions. The antibody concentrations were determined via UV absorbance against MAB01 standard curve.

N-glycans were released from EtOH precipitated and SDS denatured antibody using PNGase F (ProZyme Inc.) in 20 mM sodium phosphate buffer, pH 7.3, in overnight reaction at +37° C. The released N-glycans were purified with Hypersep C-18 and Hypersep Hypercarb (Thermo Scientific) and analysed with MALDI-TOF MS. The results are shown in Table 19.6. In the strains M627 and M629 G0 levels ranged between 24.3% to 41.7%, no G0 was seen in the strain M507.

WSG Cultivation in Shake Flasks of Strains M627 and M629 and Glycan Analysis

*T. reesei* strains M627 and M629 were cultivated in shake flasks in TrMM, 4% lactose, 2% SGE, 100 mM PIPPS, pH 5.5, at +28° C. Sampling was performed at day 5.

For N-glycan analysis MAB01 was purified from culture supernatants using Protein G HP MultiTrap 96-well filter plate (GE Healthcare) according to manufacturer's instructions. The antibody concentrations in Protein G eluents were determined via UV absorbance against MAB01 standard curve (Table 19.5). Titers in culture medium were not measured.

N-glycan release was performed as above, the results are shown in Table 19.7. G0 levels were 21.1 and 56.9% for M627 and M629, respectively.

TABLE 19.4

Antibody titers in fermentation culture supernatants of strains M627 and M629 fermented in WSG medium.

| Strain | Titer (g/l) | | | |
|---|---|---|---|---|
| | day 3 | day 4 | day 5 | day 6 |
| M627 | 0.294 | 0.580 | 0.813 | 0.818 |
| M629 | 0.292 | 0.538 | 0.755 | 0.821 |

TABLE 19.5

Antibody concentrations in Protein G eluents of strains M627 and M629 cultivated in WSG medium in shake flasks.

| Strain | Titer (g/l) in Prot G eluent day 5 |
|---|---|
| M507 | 0.303 |
| M627 | 0.105 |
| M629 | 0.103 |

TABLE 19.6

Relative proportions of neutral N-glycans from purified antibody from strains M627 and M629 fermented in WSG medium. Sampling at days 3-6.

| Composition | Short | m\z | M627 | | | | M629 | | | |
|---|---|---|---|---|---|---|---|---|---|---|
| | | | d3 % | d4 % | d5 % | d6 % | d3 % | d4 % | d5 % | d6 % |
| Hex3HexNAc2 | Man3 | 933.31 | 3.7 | 7.9 | 10.6 | 11.5 | 2.6 | 6.6 | 11.5 | 12.2 |
| Hex4HexNAc2 | Man4 | 1095.37 | 2.1 | 1.9 | 2.2 | 1.9 | 1.6 | 1.8 | 2.1 | 2.2 |
| Hex3HexNAc3 | GnMan3 | 1136.40 | 0.0 | 0.3 | 0.1 | 0.0 | 0.0 | 0.2 | 0.4 | 0.1 |
| Hex5HexNAc2 | Man5 | 1257.42 | 1.4 | 1.7 | 1.3 | 1.4 | 1.5 | 1.3 | 1.3 | 1.0 |
| Hex3HexNAc4 | G0 | 1339.48 | 31.7 | 32.6 | 28.3 | 25.0 | 41.7 | 40.0 | 42.9 | 24.3 |
| Hex6HexNAc2 | Hex6 | 1419.48 | 60.0 | 55.5 | 57.2 | 60.0 | 51.6 | 49.9 | 41.3 | 59.8 |
| Hex7HexNAc2 | Hex7 | 1581.53 | 1.1 | 0.3 | 0.3 | 0.2 | 0.9 | 0.3 | 0.4 | 0.4 |
| Hex8HexNAc2 | Hex8 | 1743.58 | 0.0 | 0.0 | 0.0 | 0.0 | 0.0 | 0.0 | 0.0 | 0.0 |

TABLE 19.7

Relative proportions of neutral N-glycans from purified antibody, at day 5, from strains M627 and M629 cultivated in WSG medium in shake flasks.

| Composition | Short | m\z | M627 % | M629 % |
|---|---|---|---|---|
| Hex3HexNAc2 | Man3 | 933.31 | 47.9 | 7.2 |
| Hex4HexNAc2 | Man4 | 1095.37 | 2.5 | 2.0 |
| Hex3HexNAc3 | GnMan3 | 1136.40 | 0.0 | 0.8 |
| Hex5HexNAc2 | Man5 | 1257.42 | 0.0 | 1.4 |
| Hex3HexNAc4 | G0 | 1339.48 | 21.1 | 56.9 |
| Hex6HexNAc2 | Hex6 | 1419.48 | 28.4 | 31.4 |
| Hex7HexNAc2 | Hex7 | 1581.53 | 0.0 | 0.4 |
| Hex8HexNAc2 | Hex8 | 1743.58 | 0.0 | 0.0 |

Example 20—Generation of GlcNAcMan5 Producing Strains with Different Promoters

Vectors for GnTI with different promoters are described in Table 20.1. The vectors were targeted into egl2 locus of *T. reesei*.

TABLE 20.1

Description of Human GnTI vectors with different promoters.

| pTTg153 | pcDNA1-Kre2-GnTI to Egl2 |
|---|---|
| pTTg167 | pcbh1-Kre2-GnTI to Egl2 |
| pTTg168 | pgpdA-Kre2-GnTI to Egl2 |
| pTTg170 | pgpdA-GnTI to Egl2 |
| pTTg171 | pcbh1-Kre2-GnTI to Egl2 (inactive GnTI) |

Materials and Methods

The generation strategy of fragments for vectors of Table 20.1 is presented in Table 20.2 and the primers used for fragment generation are listed on Table 20.3. Fragments were amplified by PCR and products were purified from the agarose gel. Digested pTTg152 vector was purified from the gel. All PCR amplifications were made with high-fidelity Phusion polymerase (Finnzymes). Fragments for pTTg153-pTTg171 were electroporated to yeast *Saccharomyces cerevisiae* FY834 for plasmid assembly by homologous recombination. Yeast cells were plated to SC-ura for 2-3 days cultivation in +30° C. Colonies were then pooled from the plates and plasmid pool was purified with Phenol/Chloroform extraction method as routinely. Plasmid pool was transformed to competent *E. coli* cells by electroporation. Electroporated cells were plated to LB+amp selection plates, cultivated +37° C. over night and colonies were screened by PCR. Positive colonies were then streaked to fresh plates as pure cultures, single colonies were cultured in liquid LB+amp media and potential vectors pTTg153-pTTg171 were purified according to standard protocols. Plasmids were analyzed by restriction analysis and sequences were verified by sequencing.

TABLE 20.2

Construction strategy of the vectors. Vectors pTTv225, pTTv77, pTTg91 were used for construction of fragments specified on below. Vectors pTTvllO, pTTvl41, pTTvll, and pTTvl3 are described in the International Patent Application No. PCT/EP2011/070956.

| Vector code | Fragment 1 | Fragment 2 | Fragment 3 | Fragment 4 |
|---|---|---|---|---|
| pTTg153 | PCR product from pTTv225 template GP346, GP471 | PCR product from pTTvl 1 template GP472, GP345 | PCR product from pTTv77 template GP348, GP349 >egl2 3' flank fragment sequence | pTTv77 cut with ClaI and FseI |
| pTTg167 | PCR product from pTTvl 10 template GP337, GP338 | PCR product from pTTv225 template GP335, GP402 >cDNA1 promoter - Kre2 targeting signal fragment amplification | PCR product from pTTvl 1 template GP472, GP345 | pTTg152 cut with FseI and AscI |
| pTTg168 | PCR product from pTTvl 4 1 template GP343, GP347 | PCR product from pTTv225 template GP335, GP402 | PCR product from pTTvl 1 template GP472, GP345 | pTTg152 cut with FseI and AscI |
| pTTg170 | PCR product from pTTvl 3 template GP343, GP399 | pTTg1 52 cut with FseI and SaiI | n/a | n/a |
| pTTg171 | PCR product from pTTvl 10 template GP400, GP401 | PCR product from pTTv225 template GP335, GP402 | PCR product from pTTg91 template GP403, GP404 Inactive GntI fragment amplification | pTTg152 cut with FseI and SaiI |

TABLE 20.3

Primers used in construction of vectors OF Table 20.2.

| Code | Sequence 5' > 3' |
|---|---|
| GP335 | ATGGCGTCAACAAATGCGCGCTATGT (SEQ ID NO: 696) |
| GP337 | ATTCACACTCTCAGAATAAATTCATCGCCAATTTGACAGGCCGGCCATTCTCACGGTGAATGTAGGCCTTTTGTA (SEQ ID NO: 697) |
| GP338 | TTAGTAGATAGCGCACATAGCGCGCATTTGTTGACGCCATGCGGTTGACTATTGGGTTTCTGTGCCTCAAAAGAT (SEQ ID NO: 698) |
| GP343 | CACACTCTCAGAATAAATTCATCGCCAATTTGACAGGCCGGCCGCCCTTGTATCTCTACACACAGGCTCAA (SEQ ID NO: 699) |
| GP345 | CTGCAGTGCAGGATCTGCATATATG (SEQ ID NO: 700) |
| GP346 | TTATTCACACTCTCAGAATAAATTCATCGCCAATTTGACAGGCCGGCCACTAGTGGTCTGAAGGACGTGG (SEQ ID NO: 701) |
| GP347 | TTAGTAGATAGCGCACATAGCGCGCATTTGTTGACGCCATCTGATGTCTGCTCAAGCGGGGTA (SEQ ID NO: 702) |
| GP348 | AGGACCTTAATTAATCATATATGCAGATCCTGCACTGCAGGCGGCCGCCACTCTGAGCTGAATGCAGAAGC (SEQ ID NO: 703) |
| GP349 | CTTGACCTCGGAGAAAGTTACCCTCCTTTTGTCAGACACGATCGATTTCCAACAGATGGAAAGAAGAAGG (SEQ ID NO: 704) |
| GP399 | AATACCGCCGCACTGGCCGTAGTGAGACTGGGTAGGTCGACTAATTCCAGCTGGGATCATA (SEQ ID NO: 705) |
| GP400 | CACACTCTCAGAATAAATTCATCGCCAATTTGACAGGCCGGCCAATTCTCACGGTGAATGTA (SEQ ID NO: 706) |
| GP401 | TTAGTAGATAGCGCACATAGCGCGCATTTGTTGACGCCATGCGGTTGACTATTGGGTT (SEQ ID NO: 707) |
| GP402 | TTCGAGGGCCGGGAGCGATGCCGA (SEQ ID NO: 708) |
| GP403 | GGCTTCAACGACCTCGTCGGCATCGCTCCCGGCCCTCGAAACGCGCCCAGCACCTGGCA (SEQ ID NO: 709) |
| GP404 | ATACCGCCGCACTGGCCGTAGTGAGACTGGGTAGGTCGACTAATTCCAGCTAGGATCATA (SEQ ID NO: 710) |
| GP471 | AGAATACCGGATTACTGATCCGGAGAATACTTTGTAAATAGCGGCCGCGGCTGATGAGGCTGAGAGAGG (SEQ ID NO: 711) |
| GP472 | CAACGACCTCGTCGGCATCGCTCCCGGCCCTCGAATGAACGGGGATGCCCTGTCGAGC (SEQ ID NO: 712) |

*Trichoderma reesei* MAB01 expression strain M507 with 7-fold protease deletion was transformed with the PmeI fragments of vectors pTTg153-pTTg171 targeted to egl2 locus. Variable amount of transformants were picked onto selective plates. On the basis of PCR screening with Phire Plant Direct PCR kit (Finnzymes F-130), clones with positive results concerning 5'- and 3'-integration were selected for single spore platings and re-screening for integration and egl2 deletion. PCR-screened strains were finally subjected to shake flask cultivation and glycan analysis.

Shake Flask Cultures of Strain M507 Transformed with GnTI and Promoter Constructs Strain M507 transformed with vectors of Tables 20.1 and 20.2 were cultivated in shake flasks in TrMM, 4% lactose, 2% SGE, 100 mM PIPPS, pH5.5, at +28° C. and sampling was performed at day 5. An inactive GnTI construct was tested to determine possible effects of GlcNAcMan5 glycans to growth of *T. reesei*.

For N-glycan analysis MAB01 was purified, concentrations were determined and N-gl yeans analysed with MALDI-TOF MS as described above. N-glycan analysis of MAB01 showed that GnMan5 levels ranged from 8 to 79.2% of the total glycans (Tables 20.4 and 20.5A and B). The inactive GnTI produced wild type glycosylation as expected.

TABLE 20.4

GnTI constructs and antibody concentrations. Strain numbers for selected clones are given in parentheses in "Clones" column.

| Focus/vector | Clones | Antibody titer g/L in ProtG eluent |
|---|---|---|
| pTTgl67 | 33-6A | 0.15 |
|  | 33-6B (M704) | 0.14 |

TABLE 20.4-continued

GnTI constructs and antibody concentrations. Strain numbers for selected clones are given in parentheses in "Clones" column.

| Focus/vector | Clones | Antibody titer g/L in ProtG eluent |
|---|---|---|
| pTTgl68 | 34-6A | 0.53 |
|  | 34-45A (M706) | 0.51 |
| pTTgl70 | 1A | 0.55 |
|  | 2A (M710) | 0.73 |
| pTTgl71 | 2A | 0.7 |
|  | 6A (M712) | 0.55 |
| pTTgl53 | 11A | 1.03 |
|  | 23A (M702) | 0.99 |
| M507 |  | 0.68 |

TABLES 20.5A and B

Relative proportions of neutral N-glycans of MAB01, at day 5.

Table A

| Composition | Short | m\z | 1A % | 2A (pTTgl70) % | 34-6A % | 34-45A % | 33-6A % | 33-6B % |
|---|---|---|---|---|---|---|---|---|
| Hex3HexNAc2 | Man3 | 933.31 | 0.0 | 0.0 | 0.0 | 0.0 | 0.0 | 0.0 |
| Hex4HexNAc2 | Man4 | 1095.37 | 0.0 | 0.0 | 0.0 | 0.0 | 0.0 | 0.0 |
| Hex5HexNAc2 | Man5 | 1257.42 | 85.0 | 74.3 | 24.5 | 19.6 | 5.0 | 5.8 |
| Hex3HexNAc4 | G0 | 1339.48 | 0.0 | 0.0 | 0.0 | 0.0 | 0.0 | 0.0 |
| Hex6HexNAc2 | Man6 | 1419.48 | 5.7 | 5.5 | 13.4 | 10.3 | 5.9 | 7.2 |
| Hex5HexNAc3 | GnMan5 | 1460.50 | 2.5 | 10.8 | 42.9 | 56.7 | 79.2 | 77.9 |
| Hex7HexNAc2 | Man7 | 1581.53 | 3.7 | 5.2 | 11.0 | 8.0 | 5.6 | 5.1 |
| Hex8HexNAc2 | Man8 | 1743.58 | 2.2 | 2.8 | 6.0 | 4.3 | 4.4 | 4.0 |
| Hex9HexNAc2 | Man9 | 1905.63 | 0.9 | 1.4 | 2.0 | 1.1 | 0.0 | 0.0 |
| Hex10HexNAc2 | Man10 | 2067.69 | 0.0 | 0.0 | 0.2 | 0.1 | 0.0 | 0.0 |

Table B

| Composition | Short | m\z | 2A (pTTg171) % | 6A % | 11A % | 23A % |
|---|---|---|---|---|---|---|
| Hex3HexNAc2 | Man3 | 933.31 | 0.0 | 0.0 | 0.0 | 1.6 |
| Hex4HexNAc2 | Man4 | 1095.37 | 0.0 | 0.0 | 0.0 | 0.0 |
| Hex5HexNAc2 | Man5 | 1257.42 | 85.7 | 89.5 | 71.8 | 70.1 |
| Hex3HexNAc4 | G0 | 1339.48 | 0.0 | 0.0 | 0.0 | 0.0 |
| Hex6HexNAc2 | Man6 | 1419.48 | 6.1 | 4.3 | 10.5 | 7.2 |
| Hex5HexNAc3 | GnMan5 | 1460.50 | 0.0 | 0.0 | 8.0 | 12.2 |
| Hex7HexNAc2 | Man7 | 1581.53 | 4.8 | 3.6 | 6.4 | 5.5 |
| Hex8HexNAc2 | Man8 | 1743.58 | 2.8 | 1.9 | 2.6 | 2.4 |
| Hex9HexNAc2 | Man9 | 1905.63 | 0.6 | 0.7 | 0.7 | 1.0 |
| Hex10HexNAc2 | Man10 | 2067.69 | 0.0 | 0.0 | 0.0 | 0.0 |

Fermenter Cultures of Strain M507 Transformed with GnTI Constructs

The *T. reesei* strains M702, M704, M706, M710, M712, M716 and M507 were fermented in 4% WSG, 2% Glc, 4% cellobiose, 6% lactose, pH 5.5, and sampling was performed at days 3-6. The antibody titers are shown in Table 20.6. N-glycans were detached and analysed as above described using PNGase F.

N-glycan analysis of MAB01 showed that GnMan5 levels ranged from 1.8 to 68.5% of the total glycans (Tables 20.7 A, B and C). The inactive GnTI produced wild type glycosylation as expected as did the control strain M507.

TABLE 20.6

Antibody concentrations of MAB01.

| Strain | d 3 | d 4 | d 5 | d 6 |
|---|---|---|---|---|
| | \multicolumn{4}{c}{Titer g/l} | | | |
| M702 | 1.23 | 1.72 | 2.14 | 2.34 |
| M704 | 0.299 | 0.399 | 0.415 | 0.479 |
| M706 | 0.293 | 1.04 | 1.65 | 2.04 |
| M710 | 0.951 | 1.09 | 1.32 | 1.69 |
| M712 | 1.34 | 1.93 | 2.34 | 2.4 |
| M716 | 0.16 | 0.519 | 1.11 | 1.69 |
| M507 | 1.04 | 1.81 | 2.24 | 2.3 |

TABLE 20.7 A, B and C

Relative proportions of neutral N-glycans on MAB01, at day 3, 4, 5 and 6.

Table A

| | | | M702 | | | | M704 | | | | M706 | | | |
|---|---|---|---|---|---|---|---|---|---|---|---|---|---|---|
| Composition | Short | m\z | d3 % | d4 % | d5 % | d6 % | d3 % | d4 % | d5 % | d6 % | d3 % | d4 % | d5 % | d6 % |
| Hex4HexNAc2 | Man4 | 1095.4 | 0.0 | 0.5 | 0.4 | 0.0 | 0.0 | 0.0 | 0.0 | 0.0 | 0.3 | 0.0 | 0.5 | 0.5 |
| Hex5HexNAc2 | Man5 | 1257.4 | 36.0 | 46.8 | 55.7 | 72.1 | 9.7 | 12.9 | 16.1 | 20.3 | 21.6 | 45.5 | 63.3 | 70.5 |
| Hex6HexNAc2 | Man6 | 1419.5 | 11.5 | 12.1 | 9.8 | 6.2 | 9.2 | 7.2 | 5.6 | 10.1 | 13.0 | 8.6 | 7.8 | 5.5 |
| Hex5HexNAc3 | GnMan5 | 1460.5 | 40.5 | 29.7 | 25.1 | 14.8 | 67.5 | 68.5 | 64.9 | 51.9 | 45.7 | 39.2 | 22.2 | 17.1 |
| Hex7HexNAc2 | Man7 | 1581.5 | 7.6 | 6.8 | 5.3 | 4.6 | 8.4 | 6.8 | 6.9 | 9.1 | 11.9 | 4.1 | 3.5 | 3.3 |
| Hex8HexNAc2 | Man8 | 1743.6 | 3.7 | 3.2 | 2.8 | 2.2 | 4.2 | 3.7 | 5.2 | 5.1 | 5.8 | 2.1 | 2.0 | 2.2 |
| Hex9HexNAc2 | Man9 | 1905.6 | 0.8 | 0.8 | 0.7 | 0.0 | 1.0 | 0.8 | 1.1 | 3.4 | 1.5 | 0.5 | 0.4 | 0.4 |
| Hex10HexNAc2 | Man10 | 2067.7 | 0.0 | 0.1 | 0.1 | 0.0 | 0.0 | 0.0 | 0.2 | 0.0 | 0.3 | 0.0 | 0.2 | 0.3 |

Table B

| | | | M710 | | | | M712 | | | |
|---|---|---|---|---|---|---|---|---|---|---|
| Composition | Short | m\z | d3 % | d4 % | d5 % | d6 % | d3 % | d4 % | d5 % | d6 % |
| Hex4HexNAc2 | Man4 | 1095.4 | 0.4 | 0.3 | 0.4 | 0.0 | 0.0 | 0.0 | 0.3 | 0.0 |
| Hex5HexNAc2 | Man5 | 1257.4 | 72.0 | 72.6 | 78.5 | 84.2 | 76.7 | 85.0 | 85.6 | 89.8 |
| Hex6HexNAc2 | Man6 | 1419.5 | 13.9 | 13.4 | 11.0 | 6.3 | 12.4 | 8.4 | 7.6 | 4.2 |
| Hex5HexNAc3 | GnMan5 | 1460.5 | 2.5 | 3.3 | 2.1 | 3.5 | 0.0 | 0.0 | 0.0 | 0.0 |
| Hex7HexNAc2 | Man7 | 1581.5 | 7.5 | 6.8 | 5.0 | 3.6 | 7.4 | 4.4 | 4.1 | 3.3 |
| Hex8HexNAc2 | Man8 | 1743.6 | 3.3 | 2.9 | 2.6 | 1.8 | 2.7 | 2.1 | 1.9 | 2.1 |
| Hex9HexNAc2 | Man9 | 1905.6 | 0.5 | 0.6 | 0.4 | 0.5 | 0.7 | 0.0 | 0.4 | 0.6 |
| Hex10HexNAc2 | Man10 | 2067.7 | 0.0 | 0.0 | 0.0 | 0.0 | 0.0 | 0.0 | 0.0 | 0.0 |

Table C

| | | | M716 | | | | M507 | | | |
|---|---|---|---|---|---|---|---|---|---|---|
| Composition | Short | m\z | d3 % | d4 % | d5 % | d6 % | d3 % | d4 % | d5 % | d6 % |
| Hex4HexNAc2 | Man4 | 1095.4 | 0.0 | 0.0 | 0.3 | 0.4 | 0.0 | 0.4 | 0.0 | 0.0 |
| Hex5HexNAc2 | Man5 | 1257.4 | 62.1 | 73.8 | 84.8 | 85.5 | 70.7 | 79.5 | 87.3 | 89.6 |
| Hex6HexNAc2 | Man6 | 1419.5 | 14.9 | 10.0 | 7.2 | 7.8 | 17.2 | 12.5 | 8.1 | 5.4 |
| Hex5HexNAc3 | GnMan5 | 1460.5 | 4.3 | 4.2 | 1.8 | 1.9 | 0.0 | 0.0 | 0.0 | 0.0 |
| Hex7HexNAc2 | Man7 | 1581.5 | 12.8 | 8.0 | 4.2 | 3.0 | 8.8 | 5.0 | 3.5 | 2.6 |
| Hex8HexNAc2 | Man8 | 1743.6 | 5.1 | 3.4 | 1.5 | 1.2 | 2.8 | 2.1 | 1.1 | 1.9 |
| Hex9HexNAc2 | Man9 | 1905.6 | 0.8 | 0.6 | 0.4 | 0.3 | 0.5 | 0.5 | 0.0 | 0.4 |
| Hex10HexNAc2 | Man10 | 2067.7 | 0.0 | 0.0 | 0.0 | 0.0 | 0.0 | 0.0 | 0.0 | 0.0 |

Example 21—Generation of GlcNAcMan5 Producing Strains with Different Targeting Peptides Generation of Plasmids Plasmids used in generating GNT1 strains with different Golgi targeting peptides (pTTv274, pTTv275, pTTv276, pTTv278, pTTv279, pTTv280) were all based on the common parental plasmid pTTv265 which contains human GNT1 (P26572) with a 38 amino acid N-terminal truncation. Pedigree of pTTv265 is summarised in Table 21.1.

TABLE 21.1

Pedigree of Golgi targeting peptide plasmids pTTv274, pTTv275, pTTv276, pTTv278, pTTv279, pTTv280. Golgi targeting peptides were added to pTTv265 generating the aforementioned plasmids.

| plasmid | content |
|---|---|
| pTTv77 | egl2 5' and 3' flanks, cbh1 promoter, pyr4 loopout marker, pRS426 backbone |
| pTTv256 | promoter change to pTTv77: cbh1 to gpdA |
| pTTv264 | selection marker change to pTTv256: pyr4 loopout to hygromycin |
| pTTv265 | human GNT1 (del38 aa) added to pTTv264 |

Stepwise Description of Generation of Plasmids

Plasmid pTTv77 contains egl2 (tre120312) 5' and 3'flanking regions for targeted integration to *T. reesei* genome and cbh1 promoter for gene expression. Integration of plasmid pTTv77 to genome results in 2456 bp deletion in egl2 locus. 1020 bp and 1024 bp regions from egl2 locus were amplified for 5' and 3'flanks. 2176 bp from cbhI locus was amplified for promoter fragment. Template used in the PCR reactions was genomic DNA of *T. reesei*. Primer used in PCR reactions are shown in Table 21.2. Selection marker pyr4 blaster cassette was a NotI fragment from pTTv71 described above and vector backbone was EcoRI/XhoI digested pRS426 described above. All fragments were purified using standard laboratory methods and plasmid was cloned by yeast recombination method as described in Examples. After plasmid rescue to *E. coli* a few clones were verified for correct recombination. Stored clone was verified by sequencing.

TABLE 21.2

Primers used in cloning pTTv77.

| Primer name | Primer sequence |
|---|---|
| T575_egl2_5'flank_F | GATTAAGTTGGGTAACGCCAGGGTT TTCCCAGTCACGACGGTTTAAACTC CAAAGTTCCTGTCTTCTCC (SEQ ID NO: 713) |
| T576_egl2_5'flank_R | TGTCAAATTGGCGATGAATTTAT (SEQ ID NO: 714) |
| T577_egl2-cbh1_prom + term_F | TTATTCACACTCTCAGAATAAATTC ATCGCCAATTTGACAGGCCGGCCGG GTAGGAATTGTCACTCAAG (SEQ ID NO: 715) |
| T572_cbh1_prom + term_R | GCAACGAGAGCAGAGCAGCAGTAGT CGATGCTAGGCGGCCGCGGCCGCTC ATCGTCTTGACAGCAATGC (SEQ ID NO: 716) |
| T578_egl2_3'flank_F | ACCAGCCGCAGCCTCAGCCTCTCTC AGCCTCATCAGCCGCGCGGCCGCCA CTCTGAGCTGAATGCAGA (SEQ ID NO: 717) |
| T579_egl2_3'flank_R | CCTATGTTGTGTGGAATTGTGAGCG GATAACAATTTCACAGTTTAAACGC GCTGCCTCCACGATGT (SEQ ID NO: 718) |

Plasmid pTTv256 is based on pTTvW. In plasmid pTTv256 promoter cbh1 was changed to gpdA. To clone pTTv256, plasmid pTTvW was digested with FseI/PacI to release cbh1 promoter. New promoter, *A. nidulans* gpdA was released from a plasmid with FseI/PacI digestion. Fragment purification and cloning were performed using standard laboratory methods. A few clones were verified for correct ligation. Stored clone was verified by sequencing.

Plasmid pTTv264 is based on plasmid pTTv256. In pTTv264 selection marker was changed from pyr4 blaster cassette to hygR selection marker. To clone pTTv264, plasmid pTTv256 was digested with NotI to release pyr4 blaster cassette. Marker hygR was amplified by PCR using modified pRLMex30 as a template with primers shown in Table 21.3. All fragments were purified using standard laboratory methods ad plasmid was cloned by yeast recombination method described in Examples. After plasmid rescue to *E. coli* a few clones were verified for correct recombination and stored clone was verified by sequencing.

TABLE 21.3

Primers used in cloning pTTv264.

| Primer name | Primer sequence |
|---|---|
| T974-Cbh1 t + NotI + PKI promoter 5'end | GACCAACTTGTCCGTTGCGAGGCC AACTTGCATTGCTGTCAAGACGAT GAGCGGCCGCATAACGGTGAGACT AGCGGC (SEQ ID NO: 719) |
| T942_pTTv256_3'end + NotI + tcbh2_rev | ATACAAACGTTGGCGAGGCTTCTG CATTCAGCTCAGAGTGGCGGCCGC GTGCTGCGGAATCATTATCATCTG (SEQ ID NO: 720) |

Plasmid pTTv265 is based on plasmid pTTv264 described above. In pTTv265 human GNT1 with N-terminal truncation of 114 nucleic acids (38 amino acids) was added under gpdA promoter. To clone pTTv265, plasmid pTTv264 was linearized with PacI. Human GNT1 was amplified by PCR from synthetic plasmid pTTv1 1 carrying full-length human GNT1 gene (P26572, pTTv1 1 is also described in the International Patent Application No. PCT/EP2011/070956). Primers used in amplification are shown in Table 21.4. All fragments were purified using standard laboratory methods. Plasmid was cloned by yeast recombination method described above. After plasmid rescue to *E. coli* a few clones were verified for correct recombination and stored clone was verified by sequencing.

TABLE 21.4

Primers used in cloning pTTv265.

| Primer name | Primer sequence |
|---|---|
| T943_GPDAp + TC + PacI + GNT1_F | GCAGCTTGACTAACAGCTACCCC GCTTGAGCAGACATCATCTTAAT TAATCAGTCAGCGCTCTCGATGG C (SEQ ID NO: 721) |
| T944_Cbh1t(pTTv256) + SwaI + GNT1_R | CCAATACCGCCGCACTGGCCGTA GTGAGACTGGGTAGGTCATTTAA ATCTAATTCCAGCTGGGATCATA G (SEQ ID NO: 722) |

The human N-terminal 38 amino acid truncated GnTI amino acid sequence in the plasmid pTTv11 for constructing pTTv265.

(SEQ ID NO: 753)

SVSALDGDPASLTREVIRLAQDAEVELERQRGLLQQIGDALSSQRGRVPT

AAPPAQPRVPVTPAPAVIPILVIACDRSTVRRCLDKLLHYRPSAELFPII

VSQDCGHEETAQAIASYGSAVTHIRQPDLSSIAVPPDHRKFQGYYKIARH

YRWALGQVFRQFRFPAAVVVEDDLEVAPDFFEYFRATYPLLKADPSLWCV

-continued

SAWNDNGKEQMVDASRPELLYRTDFFPGLGWLLLAELWAELEPKWPKAFW

DDWMRRPEQRQGRACIRPEISRTMTFGRKGVSHGQFFDQHLKFIKLNQQF

VHFTQLDLSYLQREAYDRDFLARVYGAPQLQVEKVRTNDRKELGEVRVQY

TGRDSFKAFAKALGVMDDLKSGVPRAGYRGIVTFQFRGRRVHLAPPPTWE

GYDPSWN

Plasmids pTTv274, pTTv275, pTTv276, pTTv278, pTTv279 and pTTv280 were all based on plasmid pTTv265 described above. In these plasmids different Golgi targeting peptides were added to precede the N-terminally truncated human GNTI gene. To clone these plasmids, pTTv265 was linearized with PacI. Different Golgi targeting peptides were amplified by PCR using primers shown in Table 21.5A. Template DNA for GNT2 (pTTv274) was synthetic plasmid carrying codon harmonised human GNT2 gene from the International Patent Application No. PCT/EP2011/070956). Template for other Golgi targeting peptides (pTTv276, pTTv278, pTTv279, pTTv280) was *T. reesei* genomic DNA. KRE2 (pTTv275) was produced by PCR using annealing primers in Table 21.5 A. All fragments were purified using standard laboratory methods and plasmids were cloned by yeast recombination method as described Examples. After plasmid rescue to *E. coli* a few clones from each cloning were verified for correct recombination and stored clones were verified by sequencing.

TABLE 21.5A

Primers used to produce Golgi targeting peptides in pTTv274, pTTv275, pTTv276, pTTv278, pTTv279 and pTTv280.

| Plasmid | Primer | Primer sequence |
|---------|--------|-----------------|
| pTTv274 | T945_GNT2-gts-f | GCAGCTTGACTAACAGCTACCCCGCTTGAGCAGACATCATCATGCG CTTCCGAATCTACAAG (SEQ ID NO: 723) |
|  | T946_GNT2-gts-r | GGGTGAGGCTGGCGGGGTCGCCATCGAGAGCGCTGACTGAGG GGTGATCCCCTCCCCTG (SEQ ID NO: 724) |
| pTTv275 | T1117_KRE2-gts-cds-F | GCAGCTTGACTAACAGCTACCCCGCTTGAGCAGACATCATCA TGGCGTCAACAAATGCGCGCTATGTGCGCTATCTACTAATCG CCTTCTTCACAATCC (SEQ ID NO: 725) |
|  | T1118_KRE2-gts-cds-mid-F | TACTAATCGCCTTCTTCACAATCCTCGTCTTCTACTTTGTCT CCAATTCAAAGTATGAGGGCGTCGATCTCAACAAGGGCACCT T (SEQ ID NO: 726) |
|  | T1119_KRE2-gts-cds-R | GGGTGAGGCTGGCGGGGTCGCCATCGAGAGCGCTGACTGACT TTGGTGTCGTCTTGGTCGAATCCGGAGCTGTGAAGGTGCCCT TGTTGAGATCGACGC (SEQ ID NO: 727) |
|  | T1120_gpdAp3prim-F | GCAGCTTGACTAACAGCTAC (SEQ ID NO: 728) |
|  | T1121_GNT15end-R | GGGTGAGGCTGGCGGGGTC (SEQ ID NO: 729) |
| pTTv276 | T949_KRE2-like-gts-f | GCAGCTTGACTAACAGCTACCCCGCTTGAGCAGACATCATCA TGGCCATTGCCCGGCCGGT (SEQ ID NO: 730) |
|  | T950_KRE2-like-gts-r | GGGTGAGGCTGGCGGGGTCGCCATCGAGAGCGCTGACTGAGC CCGTGGCTATCAAGAAGAAGAC (SEQ ID NO: 731) |
| pTTv278 | T953_Och1-gts-f | GCAGCTTGACTAACAGCTACCCCGCTTGAGCAGACATCATCA TGTTGAATCCACGCCGCG (SEQ ID NO: 732) |
|  | T954_Och1-gts-r | GGGTGAGGCTGGCGGGGTCGCCATCGAGAGCGCTGACTGAGG ACGTCGAGGCCGATTCG (SEQ ID NO: 733) |
| pTTv279 | T955_Anp1-gts-f | GCAGCTTGACTAACAGCTACCCCGCTTGAGCAGACATCATCA TGATGCCACGGCATCACTC (SEQ ID NO: 734) |
|  | T956_Anp1-gts-r | GGGTGAGGCTGGCGGGGTCGCCATCGAGAGCGCTGACTGATT CGAGCTTCAGGTCATCGT (SEQ ID NO: 735) |
| pTTv280 | T957_Van1-gts-f | GCAGCTTGACTAACAGCTACCCCGCTTGAGCAGACATCATCA TGCTGCTCCCCAAGGGCG (SEQ ID NO: 736) |
|  | T958_Van1-gts-r | GGGTGAGGCTGGCGGGGTCGCCATCGAGAGCGCTGACTGACT CAGATGCCGAAGTGGACAC (SEQ ID NO: 737) |

TABLE 21.5B

Amino acid sequence of targeting peptides in plasmids of Table 21.5A.

| Plasmid | Protein | TreID | Amino acid sequence |
|---------|---------|-------|---------------------|
| pTTV274 | human GNT2 | — | MRFRIYKRKVLI LTLVVAACG FVLWSSNG RQR KNEALAPPLLDAEPARGAGG RGG DHP (SEQ ID NO: 589) |
| pTTv275 | KRE2 | 21576 | MASTNARYVRYLLIAFFTI LVFYFVSNSKYEGV DLNKGTFTAPDSTKTTPK (SEQ ID NO: 590) |
| pTTv276 | KRE2-like | 69211 | MAIARPVRALGGLAAI LWCFFLYQLLRPSSSY NSPDGDRYINFERDPNLDPTG (SEQ ID NO: 591) |

TABLE 21.5B-continued

Amino acid sequence of targeting peptides in plasmids of Table 21.5A.

| Plasmid | Protein | TreID | Amino acid sequence |
|---|---|---|---|
| pTTv278 | Och1 | 65646 | MLN PRRALIAAAFI LTVFFLISRSHNSESASTS (SEQ ID NO: 592) |
| pTTv279 | Anp1 | 82551 | MMP RHHSSG FSNGYPRADTFEISPHRFQPRA TLPPH RKRKRTAI RVGIAVVVILVLVLW FGQPR SVASLSISLG ILSGYDDLKLE (SEQ ID NO: 593) |
| pTTv280 | Van 1 | 81211 | MLLPKGG LDWRSARAQI PPTRALWNAVTRTR FILLVGITGLILLLWRGVSTSASE (SEQ ID NO: 594) |

Generation of Strains with Different Golgi Targeting Peptides for GNT1

Fragments for transformations were released from plasmids pTTv274 (GNT2), pTTv275 (KRE2), pTTv276 (KRE2-like), pTTv278 (OCH1), pTTv279 (ANP1) and pTTv280 (VAN1) (Tables 21.5A and 21.5B) with PmeI. All fragments were transformed individually to MAB01 expressing strain M507 and protoplast transformations were carried out essentially as described in Examples for hygromycin selection.

Well growing clones on selective streaks were screened for the 5' and 3' integration into the egl2 locus. Double integration-positive clones were additionally screened for the loss of the egl2 ORF. The clones giving the desired results were purified through single spore platings, and the single spore-derived clones were verified by PCR to be pure integration strains. Resulting strains are listed in Table 21.6 below.

TABLE 21.6

Summary of the GnTI Golgi targeting peptide strains.

| Strain | Plasmid | Targeting peptide | TreID |
|---|---|---|---|
| M607 | pTTv274 | Human GNT2 | — |
| M685 | pTTv275 | Kre2 | 21576 |
| M610 | pTTv276 | Kre2-like | 6921 1 |
| M615 | pTTv278 | Och1 | 65646 |
| M620 | pTTv279 | Anp1 | 82551 |
| M622 | pTTv280 | Van1 | 8121 1 |

Fermentation of strains M507, M607, M610, M615, M620, M622, and M685 and glycan analysis The *T. reesei* strains M507, M607, M610, M615, M620, M622, and M685 were fermented in 4% whole spent grain, 2% glucose, 4% cellobiose, 6% lactose, pH 5.5, and sampling was performed at days 3-6. The antibody titers are shown in Table 21.7. N-glycans were detached and analysed as above described using PNGase F.

N-glycan analysis of MAB01 showed that GnMan5 levels ranged from 4 to 66% of the total glycans (Table 21.8 A, B and C). The control strain M507 showed wild type glycosylation as expected.

TABLE 21.7

Antibody concentrations from strains with human GnTI with different targeting peptides.

| | Titer g/l | | | |
|---|---|---|---|---|
| Strain | d 3 | d 4 | d 5 | d 6 |
| M507 | 0.882 | 1.54 | 1.94 | 2.09 |
| M607 | 0.536 | 1.45 | 2.22 | 2.28 |
| M610 | 0.352 | 1.04 | 1.87 | 2.19 |
| M615 | 0.554 | 1.15 | 1.76 | 1.9 |
| M620 | 0.559 | 1.24 | 1.95 | 2.21 |
| M622 | 0.697 | 1.36 | 1.8 | 2.04 |
| M685 | 0.388 | 1.05 | 1.94 | 2.44 |

TABLE 21.8 A, B and C

Relative proportions of neutral N-glycans of MABO1, at day 3, 4, 5 and 6, from strains with human GnTI with different targeting peptides.

Table A

| | | | M507 | | | | M607 | | | | M610 | | | |
|---|---|---|---|---|---|---|---|---|---|---|---|---|---|---|
| Composition | Short | m\z | d3 % | d4 % | d5 % | d6 % | d3 % | d4 % | d5 % | d6 % | d3 % | d4 % | d5 % | d6 % |
| Hex4HexNAc2 | Man4 | 1095.4 | 0.3 | 0.0 | 0.0 | 0.0 | 0.0 | 0.2 | 0.0 | 0.0 | 0.0 | 0.0 | 0.0 | 0.2 |
| Hex5HexNAc2 | Man5 | 1257.4 | 79.3 | 89.4 | 88.4 | 93.6 | 11.5 | 24.7 | 37.0 | 42.8 | 29.4 | 44.5 | 68.8 | 74.3 |
| Hex4HexNAc3 | GnMan4 | 1298.5 | 0.0 | 0.0 | 0.0 | 0.0 | 0.2 | 0.2 | 0.0 | 0.0 | 0.0 | 0.0 | 0.0 | 0.0 |
| Hex6HexNAc2 | Man6 | 1419.5 | 12.8 | 7.0 | 7.0 | 3.9 | 8.8 | 7.4 | 4.0 | 2.5 | 7.0 | 6.3 | 6.2 | 2.9 |
| Hex5HexNAc3 | GnMan5 | 1460.5 | 0.0 | 0.0 | 0.0 | 0.0 | 66.1 | 59.4 | 56.0 | 49.6 | 52.5 | 44.0 | 21.1 | 18.9 |
| Hex7HexNAc2 | Man7 | 1581.5 | 6.3 | 2.6 | 3.2 | 3.9 | 8.6 | 4.8 | 1.9 | 3.5 | 7.3 | 3.7 | 2.7 | 2.7 |
| Hex6HexNAc3 | GnMan6 | 1622.6 | 0.0 | 0.0 | 0.0 | 0.0 | 1.8 | 0.7 | 0.0 | 0.0 | 1.0 | 0.4 | 0.0 | 0.0 |
| Hex8HexNAc2 | Man8 | 1743.6 | 1.6 | 1.0 | 1.2 | 0.7 | 2.8 | 2.2 | 0.9 | 1.2 | 2.1 | 1.1 | 1.1 | 0.8 |

TABLE 21.8 A, B and C-continued

Relative proportions of neutral N-glycans of MAB01, at day 3, 4, 5 and 6, from strains with human GnTI with different targeting peptides.

| | | | | | | | | | | | | | |
|---|---|---|---|---|---|---|---|---|---|---|---|---|---|
| Hex9HexNAc2 | Man9 | 1905.6 | 0.3 | 0.0 | 0.3 | 0.0 | 0.3 | 0.2 | 0.2 | 0.4 | 0.7 | 0.0 | 0.1 | 0.2 |
| Hex10HexNAc2 | Man10 | 2067.7 | 0.0 | 0.0 | 0.0 | 0.0 | 0.0 | 0.0 | 0.0 | 0.0 | 0.0 | 0.0 | 0.0 | 0.0 |

Table B

| | | | M615 | | | | M620 | | | |
|---|---|---|---|---|---|---|---|---|---|---|
| Composition | Short | m\z | d3 % | d4 % | d5 % | d6 % | d3 % | d4 % | d5 % | d6 % |
| Hex4HexNAc2 | Man4 | 1095.4 | 0.0 | 0.0 | 0.0 | 0.0 | 0.0 | 0.0 | 0.0 | 0.2 |
| Hex5HexNAc2 | Man5 | 1257.4 | 21.7 | 36.4 | 54.1 | 51.5 | 22.0 | 35.5 | 50.8 | 63.9 |
| Hex4HexNAc3 | GnMan4 | 1298.5 | 0.0 | 0.0 | 0.0 | 0.0 | 0.0 | 0.0 | 0.0 | 0.0 |
| Hex6HexNAc2 | Man6 | 1419.5 | 10.7 | 7.7 | 6.3 | 4.2 | 10.5 | 6.6 | 5.5 | 4.3 |
| Hex5HexNAc3 | GnMan5 | 1460.5 | 57.0 | 50.1 | 36.5 | 38.8 | 57.3 | 53.0 | 40.5 | 28.0 |
| Hex7HexNAc2 | Man7 | 1581.5 | 7.4 | 3.9 | 2.0 | 3.6 | 7.2 | 3.3 | 2.3 | 2.4 |
| Hex6HexNAc3 | GnMan6 | 1622.6 | 0.8 | 0.3 | 0.0 | 0.3 | 1.2 | 0.4 | 0.0 | 0.0 |
| Hex8HexNAc2 | Man8 | 1743.6 | 2.4 | 1.4 | 1.0 | 1.3 | 1.6 | 1.1 | 0.9 | 1.1 |
| Hex9HexNAc2 | Man9 | 1905.6 | 0.0 | 0.2 | 0.0 | 0.4 | 0.3 | 0.2 | 0.0 | 0.1 |
| Hex10HexNAc2 | Man10 | 2067.7 | 0.0 | 0.0 | 0.0 | 0.0 | 0.0 | 0.0 | 0.0 | 0.0 |

Table C

| | | | M622 | | | | M685 | | | |
|---|---|---|---|---|---|---|---|---|---|---|
| Composition | Short | m\z | d3 % | d4 % | d5 % | d6 % | d3 % | d4 % | d5 % | d6 % |
| Hex4HexNAc2 | Man4 | 1095.4 | 0.0 | 0.0 | 0.0 | 0.2 | 0.0 | 0.0 | 0.0 | 0.0 |
| Hex5HexNAc2 | Man5 | 1257.4 | 63.8 | 77.9 | 85.6 | 85.0 | 29.7 | 43.1 | 70.3 | 78.3 |
| Hex4HexNAc3 | GnMan4 | 1298.5 | 0.0 | 0.0 | 0.0 | 0.0 | 0.0 | 0.0 | 0.0 | 0.0 |
| Hex6HexNAc2 | Man6 | 1419.5 | 15.0 | 9.1 | 7.3 | 4.9 | 6.5 | 6.5 | 5.2 | 3.8 |
| Hex5HexNAc3 | GnMan5 | 1460.5 | 6.4 | 7.8 | 4.1 | 4.9 | 56.3 | 44.9 | 21.7 | 14.7 |
| Hex7HexNAc2 | Man7 | 1581.5 | 10.7 | 4.0 | 2.3 | 3.5 | 4.8 | 3.7 | 2.0 | 2.1 |
| Hex6HexNAc3 | GnMan6 | 1622.6 | 0.5 | 0.0 | 0.0 | 0.0 | 0.9 | 0.3 | 0.0 | 0.0 |
| Hex8HexNAc2 | Man8 | 1743.6 | 3.3 | 1.1 | 0.6 | 1.2 | 1.9 | 1.2 | 0.7 | 1.1 |
| Hex9HexNAc2 | Man9 | 1905.6 | 0.3 | 0.2 | 0.0 | 0.2 | 0.0 | 0.2 | 0.0 | 0.0 |
| Hex10HexNAc2 | Man10 | 2067.7 | 0.0 | 0.0 | 0.0 | 0.1 | 0.0 | 0.0 | 0.0 | 0.0 |

Example 22—Silencing of Slp Genes Via RNAi and Deletion of Slp2

Figure 52:
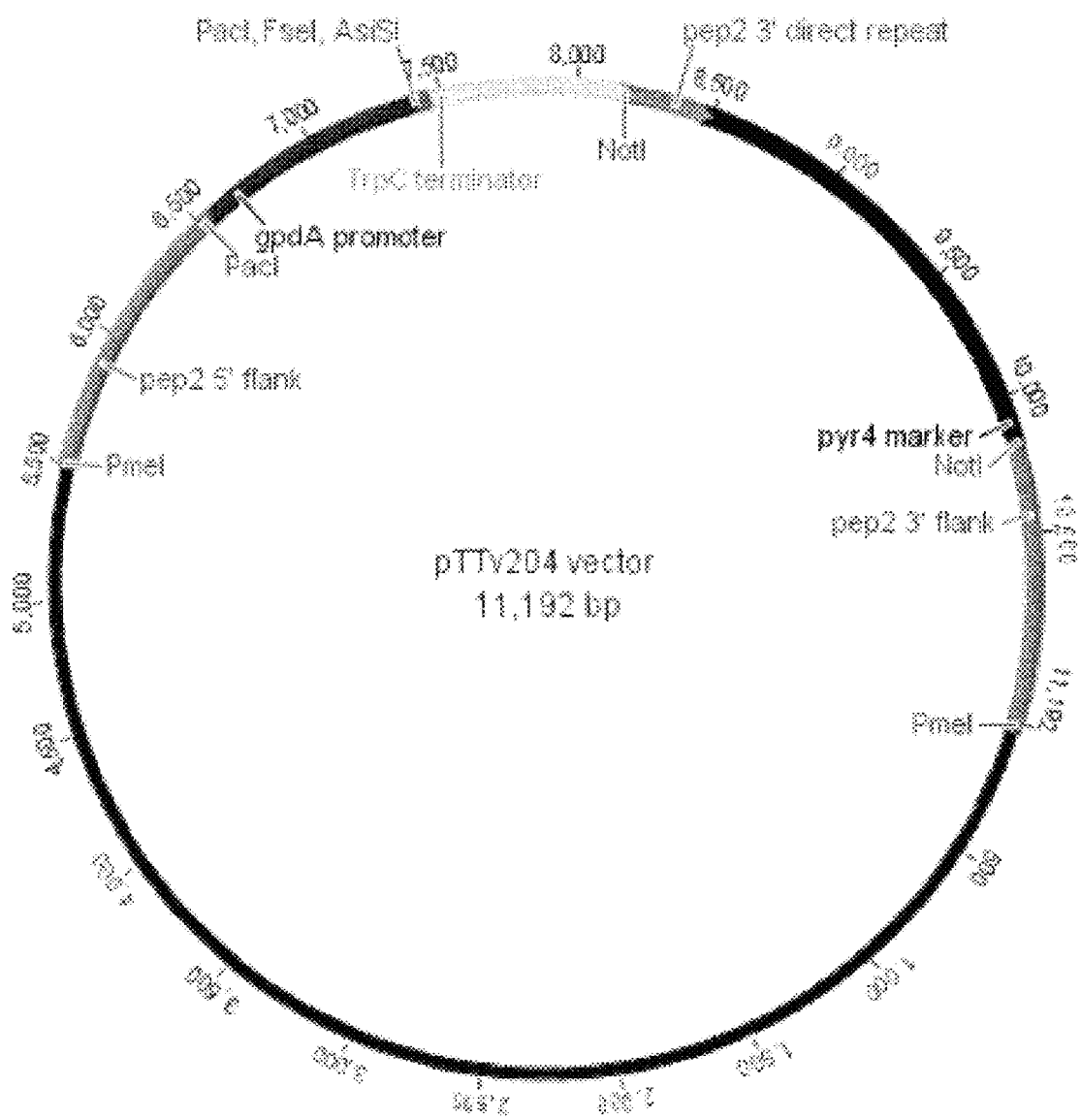
FIG. 52. The pTTv204 RNAi expression vector.

Three silencing constructs were constructed for knocking down the expression of slp2 (tre123244). These RNAi constructs contain a gpdA promoter, targeted integration to the pep2 (tre53961) protease locus, and a pyr4 loop-out marker with 3' pep2 direct repeat. Two short 19 bp target sequences and a large 448 bp sequence were inserted into this vector to create pTTv217, pTTv218, and pTTv263, respectively. These vectors were designed to knockdown the expression of slp2 and reduce its protease activity. The RNAi vectors were transformed into the pyr4⁻ version of the MAB01 production strain M507. The pTTv204 vector is shown in FIG. 52.

The pTTv204 RNAi expression vector was linearized with the AsiSI restriction enzyme. The primers T846 and T847 were annealed together and integrated via yeast recombination into the pTTv204 vector. The primers are shown in Table 22.1. The 19 base pair target sequence is contained in the resulting pTTv217 vector. The primers T848 and T849 were annealed together and integrated into the linearized pTTv204 vector to create the pTTv218 RNAi vector. This vector contains a 19 base pair target sequence. The primers are shown in Table 22.1. The target sequences are shown in Table 22.2.

The pTTv263 vector was made in two pieces and integrated into the pTTv204 vector. The primers T965 and T967 were used to amplify a 506 base pair sense fragment including the 58 base pair intron sequence in the slp2 gene. The pTTv204 vector was opened with the AsiSI restriction enzyme and the 506 sense fragment was integrated into the vector via yeast recombination. The primers T1006 and T1007 were used to amplify an antisense fragment of 448 base pair. The antisense fragment was digested with FseI and AscI restriction enzymes. The vector including the sense fragment was also digested with FseI and AscI. The vector and antisense fragment were ligated together to create the vector pTTv263. The primers are listed in Table 22.1. The target sequence is shown in Table 22.2.

The pTTv217, pTTv218, pTTv263 RNAi vectors were digested with PmeI to release the expression cassette. The fragments were separated with agarose gel electrophoresis and the correct fragments were isolated with a gel extraction kit (Qiagen) using standard laboratory methods. Approximately 5 μg of the expression cassette was used to transform the MAB01 antibody expression strain M507 (pyr4⁻ version). Preparation of protoplasts and transformation were carried out essentially as described in Example 1 for the strains M181 and M195 using pyr4 selection.

The short target sequence in the pTTv217 vector was designed to specifically affect only slp2. The pTTv218 target sequence was homologous to slp3, slp5, and slp6. The large 448 bp target sequence in pTTv263 vector was meant to affect several subtilisins. The target sequences in these vectors are listed in Table 22.2. The resulting knockdown strains M665, M666, and M667 were cultivated in small scale cultures.

Several pTTv217, pTTv218, and pTTv263 transformants were grown in 24 well cultures to compare their MAB01 production against the control strain M507. The strains were grown in TrMM with diammonium citrate without ammonium sulfate, 100 mM PIPPS, 2% spent grain extract, 4% lactose at pH 5.5. Duplicate wells were used for each transformant. Samples from the 24 well cultures taken on day 6 were used for immunoblotting. The supernatant was diluted with sodium citrate buffer pH 5.5, so that 0.5 µl of each supernatant could be loaded into the 4-15% Criterion gel. Mixed with LSB+BME and heated at 95° C. for 5 minutes. The proteins were transferred to nitrocellulose with the Criterion blotter at 100 volts for 30 minutes. The nitrocellulose membrane was blocked with 5% milk in TBST for 1 hour. The heavy chain was detected with anti-heavy chain AP conjugate antibody (Sigma #A3188) diluted 1:10,000 in TBST. After 1 hour incubation with the detection antibody, the blot was washed with TBST, and the membrane developed with AP substrate (Promega).

Figure 53:
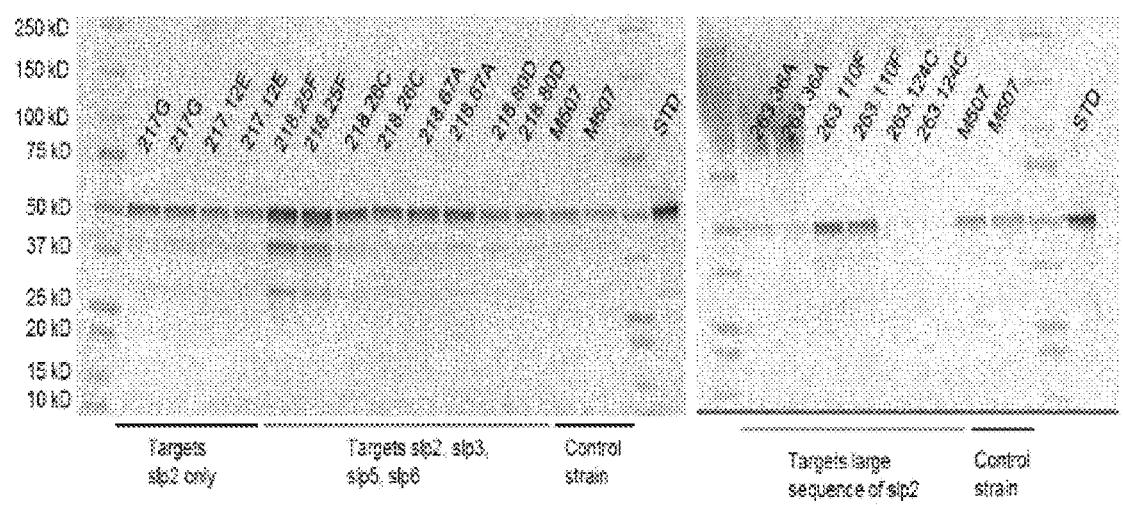
FIG. 53: Immunoblot detecting MAB01 heavy chain production in strains expressing RNAi that knocks down slp2 expression.

The results can be seen in FIG. 53. The 217.12G transformant produced slightly higher amounts of heavy chain compared to M507 or the second transformant 217.12E. The most noticeable improvement was observed with the pTTv218 transformants. Three transformants were significantly higher than the control. The 218.25F was the obvious standout. The results for the pTTv263 transformants were more variable. Two transformants produced very little antibody heavy chain. Transformant 263.11 OF seemed to produce twice as much heavy chain as the control.

The constructs that targeted multiple proteases were more successful at improving the heavy chain expression. Overall, the pTTv218 transformants were consistently better than the M507 control. The lack in production seen in two of the pTTv263 transformants indicated that the RNAi worked too well. When the slp2 gene was deleted the growth of the strain suffered and thus the antibody expression reduced as well. The 263.36A and 263.124C transformants grow very poorly and expressed very little slp2. This was confirmed by shake flask and qPCR studies.

Dry weight measurements from shake flask cultures can be seen in Table 22.5. The strains were grown in TrMM with diammonium citrate without ammonium sulfate, 100 mM PIPPS, 2% spent grain extract, 4% lactose at pH 5.5. Duplicate flasks were used for each transformant. The 263.124C transformant had difficulty growing. Generally, there was a small reduction in growth in all the strains that expressed RNAi. This effect may be related to lower slp2 expression levels.

To confirm that slp2 expression was indeed reduced by the expression of RNAi, qPCR studies were done with the shake flask study mycelia. RNA was purified from shake flask culture mycelia, cDNA was synthesized, and qPCR analysis made. The slp2, slp3, slp5, slp6, and gpd1 expression were monitored with gene specific primers. Fold changes were measured against a control strain. The expression was normalized with gpd1.

The 263.124C transformant showed the biggest downregulation of slp2 (Table 22.6). The large RNAi induced 36-fold downregulation of the slp2 gene, to a point where it was nearly turned off. The other transformants showed a much milder knockdown activity ranging from 1.2- to 2.5-fold. The milder knockdown is more preferred because the strain grows better and can produce good levels of antibody.

With two transformants it was looked more closely at what other subtilisins were affected by the RNAi expression. In the 263.124C transformant it was evident that slp3 and slp6 were also knocked down by 6- and 2.3-fold, respectably. With the milder knockdown strain 218.25F both slp2 and slp3 showed reduced expression by 1.7- and 1.8-fold.

Generation of 8-Fold Deletion Strain M646 Including Slp2 Deletion

The M646 slp2 deletion strain was made by transforming the pTTv1 15 deletion cassette into M564 (pyr4⁻ version of M507). The M564 pyr4⁻ strain was created essentially as described in Example 3 for removal of the pyr4 blaster cassette from the strain M195 (Δpep1). Consecutive 5-FOA selection steps were carried out to ensure that the clones selected were originating from single cells.

The deletion cassette containing the slp2 flanks and pyr4 marker was removed from the vector via PmeI digestion and the correct fragment was purified from an agarose gel using a QIAquick Gel Extraction Kit (Qiagen). Approximately 5 µg of the deletion cassette was used to transform the MAB01 production strain M564 (Δpep1Δtsp1Δslp1Δgap1Δgap2Δpep4Δpep3, pyr4⁻). Preparation of protoplasts and transformation were carried out essentially as described in Example 1 for the strains M181 and M195 using pyr4 selection.

Transformants were picked as first streaks. Growing streaks were screened by PCR (using the primers listed in Table 22.3) for correct integration and loss of slp2 ORF. Clones giving the expected signals were purified to single cell clones and rescreened by PCR using the primers listed in Table 22.3. The correct clone was designated as strain M646.

Fermentation of Strains M507, M665, M666, M667, and M646

The M507 strain was cultivated in fermentor cultivation series FTR104 under the same conditions as M665, M666, M667, and M646. The M646 was the slp2 deletion strain. The M665, M666, and M667 were strains with RNAi silencing. The FTR104 cultivations were grown in Trichoderma minimal medium (TrMM) plus 20 g/L yeast extract, 40 g/L cellulose, 80 g/L cellobiose, and 40 g/L sorbose at pH 5.5. The temperature was shifted from 28° C. to 22° C. after 48 hours. The cultures were grown for 6 days. Trichoderma minimal medium contains 5 g/L ammonium sulphate, 5 g/L potassium dihydrogen phosphate, 1 ml/L trace elements, 4.1 ml of 1M calcium chloride per L, and 2.4 ml of 1M magnesium sulphate per L of medium.

Total antibody concentrations were determined from day 3-6. On day 6, the M667 strain reached 3.81 g/L, see Table 22.8. After day 5 the expression of antibody dropped in the M507, M665, and M666 cultivations. On day 6 the M507 strain produced 2.2 g/L, M665 reached 2.7 g/L, and M666 made 2.8 g/L. Thus the strains with the small RNAi target sequences produced slightly more antibody than M507 indicating that the silencing is working in those strains. The strain M646 with the slp2 deletion grew more slowly than the other strains. The slp2 deletion strain produced slightly over 2 g/L on day 6.

Fermentation of Strains M507, M665, M666, and M667

The 217.12G (M665), 218.25F (M666), and 263.110F (M667) were grown in 1 L fermentors with 30 g/l glucose, 60 g/l lactose, 20 g/l WSG, 20 g/l SGE plus lactose feeding at pH 5.5 starting at 28° C. and shifted to 22° C. later in the culture. The MAB01 heavy and light chain expression was assayed by immunoblotting from supernatant samples collected each day of the culture. The supernatants were diluted in pH 5.5 citrate buffer, so that 0.1 µl could be loaded per well. LSB+BME was added and heated together for 5 minutes at 95° C. The samples were loaded into a 4-15% Criterion SDS PAGE gel. The proteins were transferred to nitrocellulose with the Criterion blotter at 100 volts for 30 minutes. The nitrocellulose membrane was blocked with 5% milk in TBST for 1 hour. The heavy chain was detected with anti-heavy chain (Sigma #A3188) and anti-light chain (Sigma #A3813) AP conjugated antibody diluted 1:10,000 in TBST. After 1 hour incubation with the detection antibody, the blot was washed with TBST, and the membrane developed with AP substrate (Promega).

The total antibody expression was measured after protein G purification and the values are presented in Table 22.4, along with the results from two control strains. The M507 strain was cultivated with and without SBTI inhibitor under the same conditions. The expression levels of MAB01 in the M667 strain were higher than those measured in the M507 parent strain. On day 9, for instance, the expression level was twice as high for M667. The expression levels observed with M667 resembled the cultivation done with addition of SBTI. The M665 and M666 strains produced levels slightly lower or similar to the control. There was a clear 2-fold increase in antibody expression compared to the standard M507 strain.

The protease activity from the cultivations listed in Table 22.4 was measured in order to determine how the total protease activities were affected by the RNAi. The protease activity measurements with casein as the substrate can be seen in Table 22.9. The total protein concentrations from all the supernatant samples were measured. The total protein concentration for all samples was normalized in sodium citrate buffer pH 5.5 to 0.625 mg/ml for all days of the cultivation.

100 µl of all the diluted supernatants were added into the 96 well plate. Three replicate wells per sample were made. Added 100 µl of casein FL diluted stock (10 µg ml) made in sodium citrate buffer pH 5.5. The casein stock solution from the vial was 1000 µg ml diluted in 200 µl of PBS. For each sample a background control was included with 100 µl of diluted supernatant and 100 µl of sodium citrate buffer pH 5.5. Incubated plates containing supernatants and substrate covered in a plastic bag at 37° C. The fluorescence was measured in the plates after 4 hours of incubation. The readings were done on a fluorescent plate reader using 485 nm excitation and 530 nm emission.

The protease activity in the supernatant of the M665 strain was the lowest overall. Throughout the culture it was almost half that of M507. The large hairpin vector M667 activity was low as well, but it began to decrease after day 5 and was lowest on day 10. This was where the antibody production for the M667 strain was highest, on day 10. At the end of the culture both the M665 and M667 culture supernatants had half the protease activity as compared to the M507 control. When the M507 culture was supplemented with SBTI protease inhibitor, the protease activity also dropped from day 6 until day 8 and remained lower than the M507 strain. The low protease activity at the end of the culture explains why the M667 strain produced twice as much antibody as compared to the M507 strain.

TABLE 22.1

Primers used for creation of the silencing vectors.

| Primer | Sequence |
| --- | --- |
| T846_pTTv217_top | CTTGAGCAGTTAATTAATTTGAATGGCCGGCCGCACACTTTCAAGAT TGGCTTCAAGAGAGCCAATCTTGAAAGTGTGCTTGCGATCGCGGATC CACTTAACGTTACTGAAATCAT (SEQ ID NO: 738) |
| T847_pTTv217_bottom | ATGATTTCAGTAACGTTAAGTGGATCCGCGATCGCAAGCACACTTTC AAGATTGGCTCTCTTGAAGCCAATCTTGAAAGTGTGCGGCCGGCCAT TCAAATTAATTAACTGCTCAAG (SEQ ID NO: 739) |
| T848_pTTv218_top | CTTGAGCAGTTAATTAATTTGAATGGCCGGCCGTACGGTGTTGCCAA GAAGTTCAAGAGACTTCTTGGCAACACCGTACTTGCGATCGCGGATC CACTTAACGTTACTGAAATCAT (SEQ ID NO: 740) |
| T849_pTTv218_bottom | ATGATTTCAGTAACGTTAAGTGGATCCGCGATCGCAAGTACGGTGTT GCCAAGAAGTCTCTTGAACTTCTTGGCAACACCGTACGGCCGGCCAT TCAAATTAATTAACTGCTCAAG (SEQ ID NO: 741) |
| T965_fw_sense_loop_ascI | CCGCTTGAGCAGTTAATTAATTTAAATGGCCGGCCTATATGGCGCGC CGTAAGTTTTGCACAGCCGC (SEQ ID NO: 742) |
| T967_rev_sense_loop_asisI | GTCAAGCTGTTTGATGATTTCAGTAACGTTAAGTGGATCCGCGATCG CCGTACTCGACGCCCTTGAC (SEQ ID NO: 743) |
| T1006_rev_antisense_fseI | CCTTATTCCTTTGAACCTTT (SEQ ID NO: 744) |
| T1007_fw_antisense_ascI | GCAACGTGCTCAGGAGTTGC (SEQ ID NO: 745) |

TABLE 22.2

Target sequences in the RNAi vectors.

| Primer | Sequence |
| --- | --- |
| pTTv217 | GCACACTTTCAAGATTGGC (SEQ ID NO: 746) |
| pTTv218 | GTACGGTGTTGCCAAGAAG (SEQ ID NO: 747) |
| pTTv263 | GTTGAGTACATCGAGCGCGACAGCATTGTGCACACC ATGCTTCCCCTCGAGTCCAAGGACAGCATCATCGTT GAGGACTCGTGCAACGGCGAGACGGAGAAGCAGGCT CCCTGGGGTCTTGCCCGTATCTCTCACCGAGAGACG CTCAACTTTGGCTCCTTCAACAAGTACCTCTACACC GCTGATGGTGGTGAGGGTGTTGATGCCTATGTCATT GACACCGGCACCAACATCGAGCACGTCGACTTTGAG GGTCGTGCCAAGTGGGGCAAGACCATCCCTGCCGGC GATGAGGACGAGGACGGCAACGCCACGGCACTCAC TGCTCTGGTACCGTTGCTGGTAAGAAGTACGGTGTT GCCAAGAAGGCCCACGTCTACGCCGTCAAGGTGCTC CGATCCAACGGATCCGGCACCATGTCTGACGTCGTC AAGGGCGTCGAGTACG (SEQ ID NO: 748) |

TABLE 22.3

Primers for screening pTTv115/Aslp2-pyr4
cassette integration and strain purity.

| Primer | Sequence |
|---|---|
| For screening integration of pTTv115 (Δslp2-pyr4) | |
| T054_slp2_5screen_F | GATGCACCGCTGCGGCC (SEQ ID NO: 327) |
| T1084_screen_5flk_pyr_rev | TCTTGAGCACGACAATCGAC (SEQ ID NO: 749) |
| T055_slp2_3screen_R | GGCGTTGCTCCCCATGCG (SEQ ID NO: 330) |
| T028_Pyr4_flank_rev | CATCCTCAAGGCCTCAGAC (SEQ ID NO: 329) |
| For screening of slp2 (tre123244) ORF | |
| T1 1 1_slp2_ORF_F | ATGCGGTCCGTTGTCGCC (SEQ ID NO: 331) |
| T112_slp2_ORF_R | TTACTCGGAGAGCTCAGAGA (SEQ ID NO: 332) |

TABLE 22.3

Primers for screening pTTv115/Aslp2-pyr4
cassette integration and strain purity.

For screening integration of pTTv115 (Aslp2-pyr4)

| Primer | Sequence |
|---|---|
| T054_slp2_5screen_F | GATGCACCGCTGCGGCC (SEQ ID NO: 327) |
| T1084_screen_5flk_pyr_rev | TCTTGAGCACGACAATCGAC |
| T055_slp2_3screen_R | GGCGTTGCTCCCCATGCG (SEQ ID NO: 330) |
| T028_Pyr4_flank_rev | CATCCTCAAGGCCTCAGAC (SEQ ID NO: 329) |

For screening deletion of slp2 (tre123244) ORF

| T111_slp2_ORF_F | ATGCGGTCCGTTGTCGCC (SEQ ID NO: 331) |
|---|---|
| T112_slp2_ORF_R | TTACTCGGAGAGCTCAGAGA (SEQ ID NO: 332) |

TABLE 22.4

Total MAB01 antibody expression levels from fermentation
cultures of RNAi strains and control strains.
Protein G purified immunoglobulins.

| Total mAB (mg/L) | T86 M507 | T89 M507 + SBTI | T113 M665 | T114 M666 | T115 M667 |
|---|---|---|---|---|---|
| day 6 | 581 | 987 | | | |
| day 7 | 719 | 1415 | 485 | 436 | 1217 |
| day 8 | 890 | 1695 | 744 | 518 | 1471 |
| day 9 | 825 | 1908 | 945 | 696 | 1684 |
| day 10 | 1082 | 1863 | 1025 | 787 | 1835 |
| day 11 | 1094 | 1769 | | | |

TABLE 22.5

Dry weight measurements from shake flask culture mycelium. Two flasks
were grown for each transformant and control strain. The strains
are expressing RNAi directed at reducing the slp2 expression.

| Dry weight | Day 3 grams/ 20 ml | Day 5 grams/ 20 ml | Day 6 grams/ 20 ml | Day 7 grams/ 20 ml |
|---|---|---|---|---|
| 217.12E | 0.015 | 0.035 | 0.042 | 0.047 |
| 217.12E | 0.022 | 0.035 | 0.049 | 0.047 |
| 218.25F | 0.031 | 0.048 | 0.052 | 0.059 |
| 218.25F | 0.038 | 0.046 | 0.051 | 0.056 |
| 218.67A | 0.027 | 0.043 | 0.052 | 0.061 |
| 218.67A | 0.024 | 0.046 | 0.051 | 0.059 |
| 263.110F | 0.032 | 0.042 | 0.047 | 0.056 |
| 263.110F | 0.025 | 0.049 | 0.043 | |
| 263.124C | 0.002 | 0.009 | 0.020 | 0.020 |
| 263.124C | 0.006 | 0.005 | 0.016 | 0.022 |
| M507 | 0.038 | 0.049 | 0.060 | 0.063 |
| M507 | 0.039 | 0.053 | | 0.066 |

TABLE 22.6

Down regulation of slp2 expression in
strains containing RNAi constructs
Fold downregulation of slp2

| | |
|---|---|
| 217.12E | no change |
| 218.25F | −1.8 |
| 218.67A | −1.2 |
| 263.110F | −2.5 |
| 263.124C | −36.3 |

TABLE 22.7

Down regulation of slp2, slp3, slp5, andslp6
expression in strains with RNAi constructs.
Fold down regulation of slp genes

| | slp2 | slp3 | slp5 | slp6 |
|---|---|---|---|---|
| 218.25F | −1.6 | −1.8 | no change | no change |
| 263.124C | −31.1 | −6.0 | no change | −2.3 |

TABLE 22.8

FTR104 cultivations were grown in TrMM plus 20 g/L yeast extract, 40 g/L cellulose, 80 g/L cellobiose, and 40 g/L sorbose at pH 5.5. The temperature was shifted from 28° C. to 22° C. after 48 hours. The total antibody titers are expressed in g/L.

| Day Total Ab | M507 g/L | M646 g/L | M665 g/L | M666 g/L | M667 g/L |
|---|---|---|---|---|---|
| 3 | 1.4 | 0.7 | 1.5 | 1.5 | 1.5 |
| 4 | 2.6 | 1.3 | 2.6 | 2.8 | 2.8 |
| 5 | 3.1 | 1.8 | 3.4 | 3.5 | 3.6 |
| 6 | 2.2 | 2.0 | 2.7 | 2.8 | 3.8 |

TABLE 22.9

Protease activity measurements of fermentation supernatants from strains with RNAi and control strains. Total protease activity at pH 5.5 with casein substrate. Protease activity Fluorescent units

| Day | T86-M507 | T89-M507 + SBTl | T113-M665 | T114-M666 | T115-M667 |
|---|---|---|---|---|---|
| 1 | 0.7 | 0.2 | 1.3 | −0.6 | 1.1 |
| 2 | 2.1 | 1.1 | −1.1 | −0.8 | 1.4 |
| 3 | 16.7 | 23.4 | 1.1 | 6.6 | 17.5 |
| 4 | 18.7 | 18.7 | 8.6 | 15.0 | 17.5 |
| 5 | 19.4 | 18.1 | 12.7 | 19.0 | 19.0 |
| 6 | 19.7 | 21.7 | 10.6 | 19.3 | 16.9 |
| 7 | 19.5 | 17.3 | 10.5 | 21.3 | 15.8 |
| 8 | 17.6 | 14.3 | 10.4 | 21.9 | 13.5 |
| 9 | 19.9 | 14.9 | 10.8 | 21.4 | 11.8 |
| 10 | 21.6 | 17.3 | 13.9 | 21.8 | 10.3 |
| 11 | 23.8 | 20.2 | | | |

Example 23—Generation of Antibody Fragment Expressing *Trichoderma reesei* Strains Seven *Trichoderma reesei* strains were generated to express antibody fragments (Fabs, multimeric single domain antibodies (sd-Ab's) and scFVs) form different protease deletion backgrounds as listed in Table 23. The architecture of the genetic expression cassettes applied for this purpose was based on the regulatory elements (promoter and terminator) of the cellobiohydrolase I (cbh1) gene. The catalytic domain of the CBHI protein was modified to remove intron sequences and used as fusion partner to enhance antibody fragment expression and secretion. A recognition motif for the Kex2 protease was inserted in between the fusion partners to promoter co-secretory release of the antibody fragments from the CBHI carrier protein. The expression cassettes were flanked by homologous regions to allow targeted integration to the *Trichoderma reesei* cbh1 locus. The entire construct was stored in a cloning vector.

In order to prepare the flanked expression cassettes for transformation the corresponding fragments were released from their respective vector backbones by PmeI restriction digestion and purified using the illustra GFX PCR DNA and Gel Band Purification Kit (GE Healthcare).

As listed in Table 23, *T. reesei* protease deletion strains were transformed with the purified expression cassettes using PEG-mediated protoplast transformation. The transformants were selected for Hygromycin B resistance or acetamidase prototrophy by plating them onto medium containing Hygromycin B as a selective agent or acetamide as the sole nitrogen source, respectively. Up to 48 transformants each were screened by PCR for homologous integration of the expression cassette to the cbh1 locus using a forward primer outside the 5' flanking region fragment of the construct and the reverse primer inside the modified CBHI catalytic domain (5' integration) as well as a forward primer inside the Hygromycin B or acetamidase selection marker, respectively, and a reverse primer outside the 3' flanking region fragment (3' integration). From each transformation, five to seven independent transformants, for which the PCR screening proved correct integration of the construct to the cbhI locus, were selected for single spore purification to obtain uninuclear clones. Proper integration of the disruption cassette was reconfirmed by PCR using the same primer combinations as described above and the absence of the parental CBHI locus was verified by using a primer combination targeted to the cbh1 open reading frame. Correct integration of the disruption cassette was additionally verified for all clones applying Southern hybridization. Genomic DNA of the uninuclear clones as well as the parental strain was independently digested with two different restriction enzyme combinations and probed against the 5' and 3' flanks of the cbh1 gene to confirm modification of the cbhI locus as expected.

Expression and Titer Analysis of Antibody Fragments (Fabs, Single Domain Antibodies and Scfvs)

Expression of antibody fragments was facilitated by the cellobiohydrolase I promoter. Strains were grown in batch fermentations for 7 days, in media containing 2% yeast extract, 4% cellulose, 8% cellobiose, 4% sorbose, 5 g/L $KH_2PO_4$, and 5 g/L $(NH_4)_2SO_4$. Culture pH was controlled at pH 5.5 (adjusted with $NH_4OH$) and temperature was constantly kept at 28° C. Fermentations were carried out in 4 parallel 2 L glass vessel reactors (DASGIP) with a culture volume of 1 L. Culture supernatant samples were taken during the course of the runs and stored at −20° C. Samples were collected daily from the whole course of these cultivations, and production levels were analyzed by affinity liquid chromatography for all molecules. For each antibody fragment the maximum titer, strain ID and protease deletion background is indicated in Table 23.

TABLE 23

Expression levels of various antibody fragments

| Antibody Fragment | Titer (g/L) | Strain | Parent Strain | Deletion Background | Clipping* (SEC after ALC) |
|---|---|---|---|---|---|
| FAb1 | 3.8 | TR090 | M307 | 4 | ~5% |
| FAb2 | 2.8 | TR102 | M400 | 6 | ~5% |
| FAb3 | 2.6 | TR104 | M400 | 6 | nd |
| sdAb-1 | 1.9 | TR066 | M307 | 4 | nd |
| sdAb-2 | 1.2 | TR101 | M400 | 6 | ~45% |
| scFV1-His | 2.5 | TR112 | M400 | 6 | nd |
| scFV2 | 2.5 | TR111 | M400 | 6 | nd |

*provided percentages are approximated (~) or not determined (nd) Titer determinations Mabs and sdAb Titer Determinations
Mabs and sdAb Mab and sdAb concentrations were quantified by HPLC-Protein A chromatography, which is based on affinity chromatography with UV detection. The Fc-domain of human immunoglobulines of the G-class (subtype-class: IgG1, IgG2, IgG4, except IgG3) binds specifically to protein A which is covalently linked to the stationary phase. The binding affinity of protein A to the Fc-domain is pH dependent. After binding at pH 7.5 the monoclonal antibody was eluted under acidic conditions at pH 2.0 and detected at 280 nm.

Fab

Fab concentrations were quantified by HPLC-anti-Lambda chromatography, which is based on affinity chromatography with UV detection. The lambda chain of human Fab fragments binds specifically to a camelid-derived anti-lambda ligand which is covalently linked to the stationary phase. After binding at pH 7.5, the monoclonal antibody was eluted under acidic conditions at pH 1.4 and detected at 280 nm.

scFV2 scFV2 concentrations were quantified by HiTrap Protein L purification using an Akta™ avant system and subsequent UV detection. The kappa light chain part of scFV2 binds specifically to the Protein L ligand which is covalently linked to the stationary phase. After binding at pH 7.2, scFV2 was eluted under acidic conditions with 0.1 mM HCl and detected at 280 nm.

scFV1-His scFV1-His concentrations were quantified by HisTrap HP purification using an Akta™ avant system and subsequent UV detection. The histidine tag of the protein binds specifically to Ni sepharose. After binding, the protein was eluted using 500 mM Imidazol and detected at 280 nm.

SEQUENCE LISTING (753 sequences)

SEQ ID NO: 1 - protein, 407 aa, Trichoderma reesei
MQTFGAFLVSFLAASGLAAALPTEGQKTASVEVQYNKNYVPHGPTALFKAKRKYGAPISDNLKSLVAARQAKQALAKRQTGSAPNHPSDSADSEYITSVSIGTPAQVLPLDFDTGSSDLWVFSSETPKSSATGHAIYTPSKSSTSKKVSGASWSISYGDGSSSSGDVYTDKVTIGGFSVNTQGVESATRVSTEFVQDTVISGLVGLAFDSGNQVRPHPQKTWFSNAASSLAEPLFTADLRHGQNGSYNFGYIDTSVAKGPVAYTPVDNSQGFWEFTASGYSVGGGKLNRNSIDGIADTGTTLLLLDDNVVDAYYANVQSAQYDNQQEGVVFDCDEDLPSFSFGVGSSTITIPGDLLNLTPLEEGSSTCFGGLQSSSGIGINIFGDVALKAALVVFDLGNERLGWAQK

SEQ ID NO: 2 - protein, 404 aa, Hypocrea lixii
MQTFGAFLVSFLAASGMAAALPTEGQKTASIEVAYNKNYVAHGPTALFKAKRKYGAPISDNLRAAVAAKHSLTKRQTGSANTNPSDSADDEYITSVSIGTPAQVLPLDFDTGSSDLWVFSSETPKSSASGHALYSPSKSSTAKKLSGSTWSIEYGDKSSSSGDVYTDIVTIGGFSVKTQAVESATKVSTQFVQDTVISGLVGLGFDIGNQVSPRPQKTWFSNAASSLAEPLFTADLRHQETGSYNFGFIDTSLAKGTIGYTPADGSEGYWGFTATGYSVGGAKLNRNSITGIADTGTTLLLLPDNIVDAYYNNVESAQYDDSQEGVVFDCSEDLPSFSFGVGGQTITISGDLLNLTPIEEGSSTCFGGLQSSADIGINIFGDVALKAALVVFDLGNERLGWAQK

SEQ ID NO: 3 - protein, 405 aa, Trichoderma asperellum
MQTFGAFLVSFLAASGMAAALPAEGQQKTISVPVIYNANHAPHGPSALYKAKKKFGAPISESLKNNVAQHKAAKLARRQTGSAPNHPSDSEDDEYITNVSIGTPAQVLPLDFDTGSSDLWVFSSETPSSQAKGHTLYNPTKSSTSKKLSGYSWTISYGDGSSSSGDVYTDTVSVGGFSVTGQAVESATKVSSEFVSDTSNSGLLGLALDSINTVSPKQQKTWFSNASSKLAQPVFTADLNHQASGSYNFGYIDTSLASGPISYVPISTANGFWEFTSASYAIGSGSTKKHSTDGIADTGTTLLLLDDTIVDAHYGQVSSAQYDNSQEGYTFDCDENLPSFTFAVGSSKITVPGSLINFAPVSGNTCFGGLQSNDGIGINIFGDVAIKAALVVFDLGNKRLGWAQK

SEQ ID NO: 4 - protein, 405 aa, Trichoderma atroviride
MQTFGAFLVSFLAASGLAAALPAEGQQKTISVPVKYNANHAPHGPTELFKAKRKFGAPISENLKNRVAEHKAAKLARRQTGSAPNHPSDSEDDEYITNVSIGTPAQVLPLDFDTGSSDLWVFSSETPSSSARGHTIYTPSKSSTSKKVSGASWSITYGDNSSSSGDVYTDTVTIGGFSVTGQAVESATKVSTQFVQDTSNSGLVGLALDSGNTVKPTKQKTWFSNASSHLAQPVFTADLNHQADGSYNFGFIDTTLASGPITYVPISTGNGFWEFTSASYAIGGGSSKKHSTDGIADTGTTLLLLDDTIVDAYYNQVESAQYDDSQEGYTFDCSEDLPSFSFAVGSSTITVPGSLINFAPVDGNTCFGGLQSDDGIGISIFGDVAIKAALVVFDLGNKRLGWAQK

SEQ ID NO: 5 - protein, 404 aa, Trichoderma virens
MQTFGAFLVSFLAASGLAAALPAEGQKTASIEVSYNKHYVPHGPTALFKAKRKYNAPISEKLHAAVAAKKALTKRQTGSANTNPSDSADDEYITNVSIGTPAQVLPLDFDTGSSDLWVFSSETPKSSASGHVTYSPSKSSTAKKLSGASWSITYGDHSSSSGDVYTDKVTVGGFSVSSQAVESATKVSTQFVQDTVISGLLGLGFDVGNTVKPRAQKTWFSNAANSLAQPLFTADLKHQQTGSYNFGFIDTTLAKGPIGYTPADGSEGYWGFTATGYSVGGAKLNRNSITGIADTGTTLLLLDDDVVNAYYNNVESAQYDDSQQGVVFDCSEDLPSFSFGVGGTTITIPGSLINLTPVSDGSSTCFGGLQSSADIGINIFGDVALKAALVVFDLGNERLGWAQK

SEQ ID NO: 6 - protein, 395 aa, Aspergillus fumigatus
MVVFSKVTAVVVGLSTIVSAVPVVQPRKGFTINQVARPVTNKKTVNLPAVYANALTKYGGTVPDSVKAAASSGSAVTTPEQYDSEYLTPVKVGGTTLNLDFDTGSADLWVFSSELSASQSSGHAIYKPSANAQKLNGYTWKIQYGDGSSASGDVYKDTVTVGGVTAQSQAVEAASHISSQFVQDKDNDGLLGLAFSSINTVSPRPQTTFFDTVKSQLDSPLFAVTLKYHAPGTYDFGYIDNSKFQGELTYTDVDSSQGFWMFTADGYGVGNGAPNSNSISGIADTGTTLLLLDDSVVADYYRQVSGAKNSNQYGGYVFPCSTKLPSFTTVIGGYNAVVPGEYINYAPVTDGSSTCYGGIQSNSGLGFSIFGDIFLKSQYVVFDSQGPRLGFAPQA

SEQ ID NO: 7 - protein, 404 aa, Aspergillus oryzae
MVILSKVAAVAVGLSTVASALPTGPSHSPHARRGFTINQITRQTARVGPKTASFPAIYSRALAKYGGTVPAHLKSAVASGHGTVVTSPEPNDIEYLTPVNIGGTTLNLDFDTGSADLWVFSEELPKSEQTGHDVYKPSGNASKIAGASWDISYGDGSSASGDVYQDTVTVGGVTAQGQAVEAASKISDQFVQDKNNDGLLGLAFSSINTVKPKPQTTFFDTVKDQLDAPLFAVTLKYHAPGSYDFGFIDKSKFTGELAYADVDDSQGFWQFTADGYSVGKGDAQKAPITGIADTGTTLVMLDDEIVDAYYKQVQGAKNDASAGGYVFPCETELPEFTVVIGSYNAVIPGKHINYAPLQEGSSTCVGGIQSNSGLGLSILGDVFLKSQYVVFDSQGPRLGFAAQA

SEQ ID NO: 8 - protein, 407 aa, Metarhizium anisopliae
MQTFGSFLVSLVVASSLATALPTTPSSTPAGNVSVTAKHNANFTRNGPAALAKAYRKFGKPVPVDVANALSRQNSKRTTGSDPNSPQQYDIEYLAPVQIGTPAQTLNLDFDTGSSDLWVFSSLTPSSQVNGQTLYNPSKSSTAQSLSGSTWSITYGDGSSSSGVVYTDAVTVGGLTVNAQAVEAAKQVSSQFSQDAASSGLLGLAFSSINTVKPTKQKTFFDNAKPALDSALFTADLKHGADGKYNFGYIDSTAYTGSIAYTPVDSSQGFWGFTSRGYAVGGGSLNTASTSGIADTGTTLLLLPSSIVSAYYAKVSGARYDSSQGGYTFACSQSLPSFSFGVSGATVTVPGAYLNYAPTDSTGRTCFGGLQSSSGIGINIFGDVALKSAFVVFDGGNNRLGWAAKAL

SEQ ID NO: 9 - protein, 406 aa, Gibberella zeae
MPSLNALLSASLAFASIALGAPAVQDKHFSVEQVKNPQFVKNGPLALAHVYAKYGVPLPKGLEKAVQKVKSSHTKRQNGSGSVITTPQDEDIEWLTPVQIGTPAQTLNLDFDTGSSDLWVFSTETSGSSGHDEYNPAKSSTSKKLSGATWSISYGDGSTSSGDVYKDKVSVGGLVVSSQAVESAQRVSDQFEQETGLDGLLGLGFSSINTVTPTQQNTFFDNAAPSLQSAVFTANLKHQKPGTYNFGFIDSSSYTGKIGYAPVDSSQGFWEFTASGYAVGSATVNRSPITGIADTGTTLLLLPSAINSAYYAKVSGARYSSSYGGYVFSCSATLPNFSFAVGGVTITIPGSYINYAPVQDGSSTCLGGIQPSEDIGINIFGDIALKAAFVVFDGGNQQVGWAKKTL

SEQ ID NO: 10 - protein, 407 aa, Fusarium venenatum
MPSLNALLAASLAFASIALGAPAVQDKHFSVEQVKNPKFIKSGPLALAHVYSKYGVPLPKGLEKAVKAVKSSSHSKRQNGSGSVITTPADEDIEWLTPVQIGTPAQTLNLDFDTGSSDLWVFSTETSGSSGHDEYNPAKSSTSKKLAGATWSISYGDGSTSSGDVYKDKVSVGGLAVASQAVESAQRVSDEFEQETGLDGLLGLGFSSINTVKPTKQKTFFDNAISTLQSPVFSADLKHQQPGTYNFGYIDSSAYTGKIGYAPIDSSGGWWEFTSSGYAVGSAALNKSPITGIADTGTTLLLLPDAVNSAYYAKVSGARYSSSYGGYVFSCSATLPNFSFAVGGVTITIPGSYINYAPVQQGSSTCLGGIQPSDDIGINIFGDIALKAAFVVFDGGNQQVGWAKKTL

SEQ ID NO: 11 - protein, 414 aa, Fusarium oxysporum
MPSINALLTASLAFASIALGAPAAQDKKFTVEQVKNPKFIKNGPLALAHVYAKYGVPLPKGLEKAVKAVRPPHAHSKRQSGSGSATTTPSDEDVEWLTPVQIGTPAQTFNLDFDTGSSDLWVFSTETTGSSGHDEYNPAKSSTAKKLSGATWKISYGDGSSSSGDVYKDKVSVGGLVVSSQAVEAAQKVSSEFEQETGLDGLLGLGFSSINTVTPTQQKTFFDNAASTLGSPVFTADLKHQKPGKYNFGFIDSTAYTGKIGYASVDSSEGFWEFTSTGYGIGSAAVNKSPITGIADTGTTLLLLPDDVNSAYYAKVSGARYSSSYGGYVFSCSATLPSFSFVVGGVTITIPGSYINYAPVQDGSTTCLGGIQPSDDIGINIFGDIALKAAFVVFDGGNQQVGWAKKTLLSLVDS

SEQ ID NO: 12 - protein, 410 aa, Grosmannia clavigera
MPSTTFLTVALAAVSAVSAMPARIGVPVSTSNFSIHQVRNEQFTGHHGPLALAKAYRKYGVALPTDLEAAVAKIQADQAVSRRDTGSATNTPTSDDSEYLTPVQIGTPAQTLHLDFDTGSSDLWVFSTETPSGSVDGQTLYKPASSSSSEKLTGATWKIKYGDDSTSSGDVYTDVVSVGGLSVQSQAVESAKTVSSSFTSDTASSGLLGLAFSSINAVLPDQQNTFFDNAQDSLDSALFTVDLKHGKAGKYNFGYIDSAAHTGSITYTDVDNAKGFWGFTADGYKIGNAAKKGTSISGIADTGTTLLLLPDAVVDAYYAGVSGASYDSSQGGYTFPSSATLPAFTYYVEGVAFTVPASYIKYAAIDSSTYFGGIQSDSSIGFSIFGDVALKAAFVIFDATPKLGFAPKTL

SEQ ID NO: 13 - protein, 411 aa, Verticillium albo-atrum
MQTFGTFFVAILAATGYAAVVPTKIGIPDQGTFSVRAVPNPGFQHRNGAIALAKAYNKFGKAAPADVAAAAANATESRLSKRTTGSATTSPEANDVEYLTPVQIGTPAQNLVLDFDTGSSDLWVFSTELPSSQVNGQTRYNPASSSTSSKVAGAKWSISYGDGSSSNGDVYLDKVTIGGLTVKKQAVEAAQKVSSSFTSDPLDGLLGLAFSSINTVSPSRQLTFFDNAKSTLDAPLFTADLKHAADPAGKYNFGYIDKTAYKGAITYTNVDNSDGFWSFTSTGYQVGTAAFKSSPVTGIADTGTTLLLLPTSVVSAYYAQVSGARYDSSQGGYVFSCSATLPAFTFGVESARIKIPGSYINFAPVDDSGSVCFGGIQRNTNIGFSIFGDVALKAAFVVFNGGDLTLGWASK

SEQ ID NO: 14 - protein, 421 aa, Chaetomium globosum
MRFFSALLAVTSVASVFARALPPFSPSTGADRRGAFSVKQVRNLNFVRSGPVQLAKIYHKYHAPLPDDLKAAVSRIRSNTLKRSNGTVETNPEANDVEYLTPVSIGTPEQVLNLDFDTGSSDLWVFSSQTKNSEVDGQTVYNPTKSSTAKELKGYTWQISYGDGSYSGGNVYTDTVTVGGLAVPSQAVEVATQVSDEFTSDPNNDGLLGLGFSSINTVEPKSQKTFFDNAMPNLDSPLFTADLKASVPGHFTFGYINPDAYIGNITYTPVDSSGGFWAWKSSGYAVGSGSFKTTTFQGIADTGTSLLLLPSSVVSAYYRQVRNATYDSTQGGYTLPCSGPVPDFAFGVGDKDTMITVPGDYITYAPTSSSGETCFGGIQPDTGIGISIYGDVALKAAFVVFDGGNMQLGWASKTLPLSTGP

SEQ ID NO: 15 - protein, 439 aa, Neurospora crassa
MVALTNLLLTTLLASAGLGAALPPRIGSTVIEAREPELPVSGRKITLPQQKNPRFHKFNGALSVYKTYLKYGAPVPDHLVQAVANHLGISVEEVHNYANTTANARRDQGSATAAPIDQSDSAYITPVSIGTPAQTLNLDFDTGSSDLWVFSNSLPSSQRAGHTIYNPSKSSTAKRVNGASWDISYGDGSSSKGQVYLDKVTIGGLVVSNQAVETAQQVSQSFTAETSIDGLVGLAFGSLNTVRPRQQKTWFENAIGQLDQPLFAADLKYEASGTYDFGFIDPAKHTGDITYVPVNTNPGYWTWTSTGYQVGSSPFVSQSITNIADTGTTLMYVPDSILRAYYGQIRGATNSQSYGGYVFPCSTEAPDFTFGVTDEATITIPGRFINYGPVTDDGETCFGGLQTSSDVGINIFGDVALKAAYVVFKGGDSPSLGWASKQL

SEQ ID NO: 16 - protein, 430 aa, Neurospora tetrasperma
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLMVDFDTGSSDLWVFSTEMSTSDIKGQTVYDPNNSSTSEKVQGSTWKITYGDGSSSSDDVYLDTVTIGNLTVPNQAVEAAKKVSSEFTDDSHNDGLLGLGFSAINAVEPTPQNTFFDNIKGSLDAPLFTVDLKHGTPGSFNFGYIDPTAYIGNISWTPVDSSQGYWGFTSPGYAVGTGAFRNHSMSGIADTGTTLLLLPKSVVSAYYKEIQGAQYDSDQGGYIFPCSPTPPDFVFGVNNGIVTVPGDMVSYAPADSANQNCFGGIQKDTGIGFSIFGDVALKTSFVHLHSSIVPGHYADCDMRFNRMLRSYLVDFSSSGPL

SEQ ID NO: 17 - protein, 452 aa, Trichoderma reesei
MEAILQAQAKFRLDRGLQKITAVRNKNYKRHGPKSYVYLLNRFGFEPTKPGPYFQQHRIHQRGLAHPDFKAAVGGRVTRQKVLAKKVKEDGTVDAGGSKTGEVDAEDQQNDSEYLCEVTIGTPGQKLMLDFDTGSSDLWVFSTELSKHLQENHAIFDPKKSSTFKPLKDQTWQISYGDGSSASGTCGSDTVTLGGLSIKNQTIELASKLAPQFAQGTGDGLLGLAWPQINTVQTDGRPTPANTPVANMIQQDDIPSDAQLFTAAFYSERDENAESFYTFGYIDQDLVSASGQEIAWTDVDNSQGFWMFPSTKTTINGKDISQEGNTAIADTGTTLALVSDEVCEALYKAIPGAKYDDNQQGYVFPINTDASSLPELKVSVGNTQFVIQPEDLAFAPADDSNWYGGVQSRGSNPFDILGDVFLKSVYAIFDQGNQRFGAVPKIQAKQNLQPPQ

SEQ ID NO: 18 - protein, 454 aa, Trichoderma atroviride
MEAIFNVQSKFALERGLSKIKAIRNENYKRHGTKSYVYLLNRFGFEPTKPGPYFQGASFHQRGLAHPDFHEARGGRVHKKKHLKKKQTPEGATDPNGTETGEVGAEDQQNDSEYLCEVTIGTPGQKLLLDFDTGSSDLWVFSTELSKSLQSNHTVFNPKNSSTFKALTGQKWQISYGDGSSASGDCGSDDVTVGGLTIKNQTVELASTLAQQFAQGTGDGLLGLAWPSINTVTTNGKPTPANTPVANMITQEDVPSESELFTAAFYSERDANAQSFYTFGYIDQDLVTASGQQIAWTDVDNSQGFWMFPSTSSSVNGKAISQSGNSAIADTGTTLALVSDDVCDALYKAIPGAKYDDQQQGYVFPMSTDVSSLPEFKVSVGNTQFVIQPEDLAFAPADNNNWYGGVQSRGDNPFDILGDVFLKSVYAIFDQGNQRFGAVPKIQATQNLNPPSNQ

SEQ ID NO: 19 - protein, 453 aa, Trichoderma virens
MEAIFQAQAKFRLDRGLTKVKAIRNQNYKRHGTKSYVYLLNRFGFEPTKPGPYYQQHRIRQRGLAHPDFHAPVGGRVHHTKHLHKKVNKHGAPDATGTETGEVGAEDQQNDSEYLCEVTIGTPGQTLLLDFDTGSSDLWVFSTELSKTIQKGHSVFQPTSSSTFKKLPNQAWQISYGDGSSASGDCGSDNVTIGGLTIKNQTVELASKLAQQFAQGTGDGLLGLAWPAINTVATNGKSTPANTPVANMITQDDIPSDAELFTAAFYSERDANAQSFYTFGYIDTDLVSSSGQDIAWTDIDNSQGFWMFPSTSTSVNGKAISQSGNSAIADTGTTLALVSDEVCEALYNAIPGATYDDQQQGYVFPQSTDVSSLPEFKVSVGDTQFVIQPEDLAFAPADDNNWYGGIQSRGTNPFDILGDVFLKSIYAIFDQGNQRFGAVPKIQASQNLSSSAQ

SEQ ID NO: 20 - protein, 454 aa, Hypocrea lixii
MEAIFQAQAKFRLDRGLHKITAIRNKNYKRHGTKSYVYLLNRFGFEPTKPGPYFQEHRVHQRGLVHPDYNAPVGGRVHITKALHKKKNHHGALDANGSEKGEVGAEDQQNDSEYLCEVTIGTPGQKLLLDFDTGSSDLWVFSTELSKSLQKNHTIFNPSESSTFKKLSGQTWQISYGDGSSASGDCGSDNVTIGGLTIKNQTVELASKLAAQFAQGTGDGLLGLAWPSINTVATNGRSTPANTPVANMITQDDVPSNAELFTAAFYSERDANAESFYTFGYIDQDLVTASGQDIAWTDVDNSQGFWMFPSTSSSVNGQAISQSGNSAIADTGTTLALVSDEVCDALYKAIPGATYDDQQQGYVFPMSTDVSSLPEFKVSVGDTQFVIQPEDLAFAPADDNNWYGGVQSRGSNPFDILGDVFLKSVYAIFDQGNQRFGAVPKIQATQNLDSSSAQ

SEQ ID NO: 21 - protein, 454 aa, Trichoderma asperellum
MEAIFNVQTKFRLERGLSKIRAIRNENYKRHGTKSYVYLLNRFGFEPTKPGPYFQGVQFHQRGLAHPDFHEARGGRVHKKKHLRKKVTPEGSTDPNGTETGEVGAEDQQNDSEYLCEVTIGTPGQTLLLDFDTGSSDLWVFSTELSSTIQKGHTVFNPKNSSTFKALTGQKWQISYGDGSSASGDCGSDNVTVGGLTIKNQTVELASTLAQQFSQGTGDGLLGLAWPSINTVTTDGKPTPANTSRCQHITQDDVPSEAQLFTAAFYSERDANAQSFYTFGYIDNDLVTASGQDIAWTDVDNSQGFWMFPSTSSSINGKAISQSGNSAIADTGTTLALVSDEVCDALYKAIPGAKYDDQQQGYVFPMSTDVSSLPEFKVSVGDTQFVIQPEDLAFAPADNSNWYGGVQSRGNNPFDILGDVFLKSVYAIFDQGNQRFGAVPKIQATQNLNSSSNQ

SEQ ID NO: 22 - protein, 426 aa, Aspergillus niger
MATKIKLIPNLNYKRSGTKSYVHLMRKYRFHPTKPGPYTLSSSIQQTGRPYTEKPIGGRAHIRQLVRKKSTTSDEVGEVPAEDVQNDSMYLATVGIGTPAQNLKLDFDTGSADLWVWSNKLPSTLLSENKTHAIFDSSKSSTFKTLEGESWQISYGDGSSASGSVGTDDVNIGGVVVKNQAVELAEKMSSTFAQGEGDGLLGLAFSNINTVQPKSVKTPVENMILQDDIPKSAELFTAKLDTWRDTDDESFYTFGFIDQDLVKTAGEEVYYTPVDNSQGFWLFNSTSATVNGKTINRSGNTAIADTGTTLALVDDDTCEAIYSAIDGAYYDQEVQGWIYPTDTAQDKLPTVSFAVGEKQFVVQKEDLAFSEAKTGYVYGGIQSRGDMTMDILGDTFLKSIYAIFDVGNLRFGAVQREELRQSLKSE

SEQ ID NO: 23 - protein, 459 aa, Aspergillus fumigatus
MSSCRFSNTLKTATASPCKYLHTTTTITMATRIKLLPNPHYRKSGTKSYVHLMRKYRFTPTKGGRYFLSSSLHQTGRQYTHLPVGGRARIQHVLRKRIADTDETSDVGADDVQNDTMYLAPVSIGTPAQTIHLEVDTGSADLWVWSTHLAPATIAQHKTGTVFDPSKSSTFEEQSGSTWKISRDDGSFAFGTVGTDTISLGGLRVEHQAIELADSLSAQYEQGTGDGLLGLAFSHINTVRPQPVRTLVENMVAQEDIPESAKLFTAKLGCWQGANEPDEGEPFFTFGFIDQDIVTASGEEVYYTPIDNSRGFWLFDSASATVNGKTIARSGNKAIADTGTPLALVDDETCQAIYDAIPGAHYDDESQGYIFPSTTTADKLPVVSLAVGDKQFVVQREDLGFAEAKSGYVYGGIQSRGSMAMDILGSTFLKGIYPIFDVGNLRFGAVQRKELHQNLSAPQ

SEQ ID NO: 24 - protein, 393 aa, Aspergillus niger
MRKYRFHPTKPGPYTLSSSIQQTGRPYTEKPIGGRAHIRQLVRKKSTTSDEVGEVPAEDVQNDSMYLATVGIGTPAQNLKLDFDTGSADLWVWSNKLPSTLLSENKTHAIFDSSKSSTFKTLEGESWQISYGDGSSASGSVGTDDVNIGGVVVKNQAVELAEKMSSTFAQGEGDGLLGLAFSNINTVQPKSVKTPVENMILQDDIPKSAELFTAKLDTWRDTDDESFYTFGFIDQDLVKTAGEEVYYTPVDNSQGFWLFNSTSATVNGKTINRSGNTAIADTGTTLALVDDDTCEAIYSAIDGAYYDQEVQGWIYPTDTAQDKLPTVSFAVGEKQFVVQKEDLAFSEAKTGYVYGGIQSRGDMTMDILGDTFLKSIYAVSALLLALRGDIEAH

SEQ ID NO: 25 - protein, 439 aa, Cordyceps militaris
MEAFFQAQAKFQASPGLTKVRAKPNQNYKRHGTKSYVYLLNRFGFEPTKPGPYRRVSHLQQRGLAQSHVAVGGRAAVTSRLAKTLDAAGTQTGEVTAEDQQNDSEYLCEVSIGTPPQKVLLDFDTGSSDLWIFSTELSKATQKGHTIFNPSKSSTFKKLPGQTWQISYGDGSSASGDCGSDNVTIGGLTIEGQTVELASKLAAQFAQGTGDGLLGLAFPAINTVKKNGQPAPAQTPVANMMTQGDIPKQSQLFTSAFYSERDADGPQSFYTFGYVDEALVKASGKDIAWTKIDSSEGFWMFPSASVSIAGKKLALDGNTAIADTGTTLALVSDEVCDALYKAIPGAKYDAQQQGYVFPLTTKPEDLPAFEVAAEDLAFAQADDKNWYGGVQSRGSNPFDILGDAFLKSVYAIWDQGNQRFGAVPKIEKTQNLTAKAQSQ

SEQ ID NO: 26 - protein, 447 aa, Glomerella graminicola
MQAFFQAQAKFKADNGLAKIPVVPNKNYNRHGRKSYVHLLNKFKFEPTKPGPYVQTRRMAQRGLAAPGFNAPVGGRVSMSKVLVKKTEGDQHGEVTAEDQQYDSMYLCEVSIGTPPQKFKLDFDTGSSDLWVFSKELSSSLQRNHNVFDPSKSSTFKKLEGKTWKISYGDGSSASGDCGTDNLVLGGLTVKNQVTELAAHLAPQFSQGTGDGLLGLAFSSINTVQNKGGARDPQATAVDNMIAESDIPKDAELFTSAFYSERDESKPRSFYTFGWIDTELVEASGEDIHWVDIDNTQGFWMFSSESASVNGKAVAQSGNKAIADTGTTLALVSDEVCQALYDAIPGSKYDEQQQGYVFPTSIKAEDMPEFKVAVGDKEFVIQKEDLAFAPASDGFWYGGVQSRGSNKFDILGDAFLKSIYAIWDQGNTRFGCVPKIEKTQNLQPSSS

SEQ ID NO: 27 - protein, 461 aa, Fusarium oxysporum
MEAIYQVQHQFRLDRGLTRISVKRNPHYQPHGTKSYVHLLNRFGFKPTKPGPYFQDRQIQQRGLAHPRFHAAVGGRVYQTKILRKKLGTDGTLDADGTQIGEVTAEDLPFDSMYLCEVSIGTPPQKFNLDFDTGSADLWVNIPNEALKQRVKNTDQKGHNVFNPLSSSSFNELTDKTWKISYGDGSSASGDCGSDDVTIGGLTIKNQTVELASQLDQQFARGKGDGLLGLAFPQINTVKTNWDSDPADTPVVNMINQHDIPKEAELFTSAFYSQRDANSPESFYTFGFIDTDLVARSGEEISWTRIDSSDGFWKFPSARFSVKGKIIDLSGNKAIADTGTTLVLVSDEVCEALYDAIPGARYSPTQQGYVFPRSTNVEDLPEFKVAIGDKQFDIQPQDLVFAPADKDNWYGGIQSRGNLPFDIFGDAFLKSVYAIWDQGNKRFGVVPKIEETQNLDPTPIA

SEQ ID NO: 28 - protein, 452 aa, Grosmannia clavigera
MQSIFQVQRQVRADLGLEKVRVILNKNYKANGTKSYVHLLNRYGFQPTKPGPYRHVNRVHQRGLRVTDITKVHKPVGGRVHLEKVLAKHSATGDGNTQAGEVTAEDQQNDSMYLCEVEIGTPSQKLMLDFDTGSSDLWVFSTELSADVQKGHAVFDSSKSTTFKTSSGLTWQIEYGDGSSASGDVGTDVVTVGGLVIKNQSVELAKTLAAQFSQGTGDGLLGLAWPSINTIKSGYSSDPQPTPVANMISEGVVPKEAQLFTSCFYGERDNQESFYTFGYIDEDLVKASGAEIAWTSIDNSQGFWMFPSTSASINGQSITLSNNTAIADTGTTLALVSDEVCEALYKAIPNSKYDEKQQGYLIPKTTTIDQLPTVSITVGDNKFVVQKEDLIFTQADDTHWYGGIQSRGSNTFDILGDVFLKSIYAIWDQGNVRFGAVPKIQKTQTLDPGSST

SEQ ID NO: 29 - protein, 432 aa, Botryotinia fuckeliana
MASLQGLSKIRLIPNKNYKRSGTKSYVYLLNKWGFEPTKPGPYFQMNKATATSASFHKFGHKSQTQRVLAKKTATGENGEVPAEDQQNDSEYLCPVQIGTPAQTLMLDFDTGSSDLWVWSTELPKATTSNATGHTIFDPKKSSTFKAAKSSKWQISYGDSSSASGTVGTDTVSLGGLAIKNQAVELATKLSAQFEQGAGDGLLGLAWGSINTVTPTPVATPVENMISQEDIPSDAELFTVNLGSWRDADEADKGASFYTFGYIDQDVVGSQEIYYTPVDNSQGFWMFDSTSATVNGKTVAQTGNQAIADTGTTLALVSDETCQAIYDAIPGSTYDSEQQGYTFPSNTSADDLPVVTFAVGGKQFAVQKEDLGFADAGNGMVYGGIQSRGSMTFDILGDTFLKGIYAIFDQGNTRFGAVQRTEATQNTAAPPA

SEQ ID NO: 30 - protein, 677 aa, Thielavia terrestris
MEADFQLFSSLRYDPVLLQVPASNLTHAGWNWVTSSPLYMLDYHRDRMLQAAAHWGWQAAVEVLDGDAGLKRLAGFVMDSIGGNQPSPLRVRVSISKKGEMSVISGPVPEMPLANLFPTRLPAPGEDPEEAHSNGRSDGQPSKTPEYEILVDSLGATWTAHSHFKTTKRAVYDGARQRAQISLADKKEVLIVNEADGTVMEGSTTTPYFWREGRWVTPAVNMEDKSEKGAGGQNGTSRRWALEKYVNTTPRPRHQDDRHHRHLHKVKIIHNQNYQRHGTKSYVSVLNRFGFQPTKPGPYFQKFTKPTDEAARGKTGPGVKPGHVWVGLYKKTKDDQVGEVTAEDQQNDAEYLCEVSIGTPPQKVTLDFDTGSADLWVNHKSFAPHKSSTFKLAPNMSWRIQYGDGSSASGSVGLDVLSIGGLTIKNQAIEIATTMSDQFSQGSMDGLLGLAFSKINTVETNGQPDPQPTPVENMITQEDIPEDSELFTSAMYSTRDQGEQSFYTFGWIDQDLVKASGQDISWTNVDTSQGFWMFPSESATVNSKKLSLSGNKAIADTGTTLALVSDEVCEALYSQIQGSYYSEQYQGYIIPKSITADDLPDFSVAVGDKEFVIQKEDLLFALADDNSWYGAVQSRGENPFDILGDAFLKSIYAIWDQGNSRFGAVPKIEKTQNIKPE

SEQ ID NO: 31 - protein, 433 aa, Sclerotinia sclerotiorum
MATLQGLSRVRLVPNKNYKRSGIKSYVYLLNKWGFEPTLPGPYFQMNKATEREATYHKFGHKSHHHKRHLAKKTPTGENGEVPAQDQQNDSEYLCPVQIGTPAQTLMLDFDTGSSDLWVWSTELPKSTTSKATGHTIFDPTKSSTFKASKSSKWQISYGDSSSASGTVGTDTVTIGGLAIKNQAVELATKLSAQFEDGAGDGLLGLAWGSINTVTPEPVATPVMNMITQEDIPKDAELFTVNLGSWRDAEDPDKGESFYTFGYIDKDIVGSQEISYTPIDNSQGFWMFDSTSATVNGKTITQDKNQAIADTGTTLALVSDETCQAIYDAIPGSTYDQTQQGYTFPSSTSADDLPVVTFAVGGKQFAVQKEDLGFADAGNGMVYGGIQSRGSMTFDILGDTFLKGIYAIFDQGNVRFGAVQRNEPTQNTSAPPS

SEQ ID NO: 32 - protein, 722 aa, Chaetomium globosum
MDNDFQLFTSLRYDPALLQVSVRKLSYGGWNSVNSSPLYMLDYHRDRMLRAATHWGWNAAVDVLQGDSGLKRLVELVESSIREDQQSPLRVRIAITKDGELSITSGPVPETTLANLFPENLPPPERAGHDGEGRDIPSKSPGYEILVDTPITTRSEHTHFKTTKRAAYDGARQRAQISLFDLKEVLIVNETNGAVMEGSTTTPYFWRDGRWVTPAVSKEYNLEDGSGGQSGTSRRWALERFVNIIFSGRLERPFPRMDDALFQTHADLRKRLALHKIKAIPNSNYKRHGTKSYVSVLNRFGFQPTQPGPYYQKFIKSDDIPPKAAPGVRPGRIWAGLFKKVEGKKEGGEVTAEDQQNDAEYLCEVTIGTGVGSDIQKVMLDFDTGSADLWVSHKKFDHTKSSSFQLAKDKTWKIQYGDGSSASGTVGTDVLVLGGIIIKKQAIEIANEMSAQFSEGTMDGLLGLAFSKINTVQSGGKPDPQLTPVDNMIAQEDIPKEAELFTSAIYSNRDEDRRSFYTFGWIDEDLVKASGEEIAWTNIDKSEGFWMFSSEHASVNGERITIEGNKAIADTGTTLALVTDKVCAALYSKIPGAEYNAEYQGWTIPQSIPVDELPDFSVAVGGKEFVIQKEDLIFVPADKKFFYGGVQSRGENPFDILGNTFLKSIYAIWDQGNSRFGAVRKIEPFQHPIKYNLQPLSSDERTKLGIKKGYGDINTIPFTESA

SEQ ID NO: 33 - protein, 481 aa, Neurospora tetrasperma
MGSMYQVQSKLRQDLGLHKVQAVRKPGRELNGTKAYVSAMARYGFNPTEESRFFHLKKTDLTKEFQRRGYTRHWEQLVRTPQERPDDPQTDNEPIPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQDDIPKEAELFTSAFYSARDDKSEEKSFYTFGWVDEDLVKASGKDITWTPIDNSEGFWKFPSESATVDGENVSVSGNAAIADTGTTLALVSDTVCKALYAKIPGSKYSYRYQGYLIPSTITADQLPQLSVAVGGEQFVIQKEDLLLAPADDDHWYGGVQSRGTMPFDILGDTFLKSIYAIWDQGNNRFGAVPKIEVNQHTVFPNTESSPEANSPEPADKIGDVSPVEQVKGAVKSLKLL

SEQ ID NO: 34 - protein, 481 aa, Neurospora crassa
MGSMYQVQSKLRQDLGLHKVQAVRKPGRELNGTKAYVSAMARYGFNPTEESRFFHLKKTDLTKEFQRRGYIRHWEQLVRTPQERPDDPHTDNEPVPAEDQQYDTQYLCEIGIGTPQQKVKLDFDTGSADLWVRCTDSSLLHHADKKFDPKKSDTFQESKTDQTWKIQYGDGSTASGTVGTDVITVGGLQIKNQAIELAKKVSSAFSSGEADGLLGLAFSTINTIESDGKPDPQPTPVENMISQEDIPKEAELFTSAFYSARDDKSEEKSFYTFGWVDEDLVKASGKDITWTPIDNSEGFWKFPSESATVDGDNVSVSGNTAIADTGTTLALVSDTVCKALYAKIPGSKYSYRYQGYLIPSTITADQLPQLSVAVGGEQFVIQNEDLLLAPADDDHWYGGVQSRGTMPFDILGDTFLKSIYAIWDQGNNRFGAVPKIEVNQHTVFPDTEPSPEASSPEPADKVGDVSPVEQVKGAVKSLKVL

SEQ ID NO: 35 - protein, 459 aa, Neosartorya fischeri
MSSCRFSNTLKTAAASLCNYLHTTTTITMATKIKLLPNPQYRKSGTKSYVHLMRKYRFTPTKGGRYFLSSSLHQTGRQYTNLPVGGRARIQHVLRKRIADTDETSEVGADDVQNDTMYLAPVSIGTPAQTVNLEFDTGSTDLWVWSTNLPSATISQHKTGTIFDPSKSSTFKEQSGSTWKISYDDGSFASGTVGTDTISLGGLKVENQAIKLADTLSAQFEQGTCDGLLGLAFSNINTVKPQAVRTPVENMIAQEDIPKSAKLFTAKLGTWKDANEPDEGEPFYTFGFIDQDTVTASGEEVYYTPIDNSQGFWLFDSASATVNGKTIARSGNKAIADTGTTLALVDDETCQAIYDAIPGAHYDDESQGYIFPSNTTEDKLPVVSFAVGDKQFVVQREDLGFAEAKSGYVYGGIQSRGSMTMDILGDTFLKGIYAIFDVGNLRFGAVQRKELHQNLSVPQ

SEQ ID NO: 36 - protein, 431 aa, Penicillium marneffei
MTSKVRVLLNPKYKRNGTKSYVHLLRKYGFDTTLDGPYFHVSHVHQQGKFTTAGQKTVGGRVRIHRTLQKKVNGQAGDVPADDVQNDTMYLAQVGIGTPAQTLKLDFDSGSADLWVWSTELPSSTQSSGSGHTIFDPSKSSSWNSSSGQKWQISYGDGSSASGDVGTDTLNLGGIEVKNQAIEIAKNLSSQFQQSEGDGLLGLAWGSINTVQPQAVQTPMQNLISQNLLPSNAQLFTAHLGEATAKTDNTFYTFGYIDQDTLNATGNQIAYADVDNNQGFWTFQSTSATVNGKTINRSANTAIADTGTTLALIDDNTLKTIYDAIPGSKYDSTQQGYIFPSNTPTDKLPTVTFAVGGSQIAVHKSALGFADAGNGYVYGGIQSRGTNPFDILGDTWLKGLYAVFDVGNTRFGAAAKADPDASSSSSSSSSS

SEQ ID NO: 37 - protein, 395 aa, Trichoderma reesei
MKSALLAAAALVGSAQAGIHKMKLQKVSLEQQLEGSSIEAHVQQLGQKYMGVRPTSRAEVMFNDKPPKVQGGHPVPVTNFMNAQYFSEITIGTPPQSFKVVLDTGSSNLWVPSQSCNSIACFLHSTYDSSSSSTYKPNGSDFEIHYGSGSLTGFISNDVVTIGDLKIKGQDFAEATSEPGLAFAFGRFDGILGLGYDTISVNGIVPPFYQMVNQKLIDEPVFAFYLGSSDEGSEAVFGGVDDAHYEGKIEYIPLRRKAYWEVDLDSIAFGDEVAELENTGAILDTGTSLNVLPSGLAELLNAEIGAKKGFGGQYTVDCSKRDSLPDITFSLAGSKYSLPASDYIIEMSGNCISSFQGMDFPEPVGPLVILGDAFLRRYYSVYDLGRDAVGLAKAK

SEQ ID NO: 38 - protein, 395 aa, Trichoderma virens
MKSALIAAAALVGSAQAGVHKMKLQKVSLEQQLEGSTIESQVQHLGQKYMGVRPTSRADVMFNDKLPKIQGGHPVPVTNFMNAQYFSEITIGTPPQTFKVVLDTGSSNLWVPSQSCNSIACFLHATYDSSSSSTYKQNGSDFEIHYGSGSLTGFISNDVVTIGDLKIQKQDFAEATSEPGLAFAFGRFDGILGLGYDTISVNGIIPPFYQMVNQKLLDEPVFAFYLGSGDEGSEAVFGGVDESHYSGKIEYIPLRRKAYWEVDLDSIAFGDEVAELENTGAILDTGTSLNVLPSGLAELLNAEIGAKKGFGGQYTVDCSKRDSLPDITFSLAGSKYSLPATDYIIEMSGNCISSFQGMDFPEPVGPLVILGDAFLRRYYSVYDLGKNAVGLAKAK

SEQ ID NO: 39 - protein, 395 aa, Trichoderma atroviride
MKSALIAAAALVGSAQAGVHKMKLQKVSLEQQLEGSSIEAQVQQLGQKYMGVRPTSRVDVMFNDNVPKVKGGHPVPVTNFMNAQYFSEITIGSPPQTFKVVLDTGSSNLWVPSQSCNSIACFLHSTYDSSSSSSYKKNGSDFEIHYGSGSLTGFISNDVVTIGDLQIKGQDFAEATSEPGLAFAFGRFDGILGLGYDTISVNGIVPPFYQMVNQKLLDEPVFAFYLGSGDEGSVATFGGVDESHYSGKIEYIPLRRKAYWEVDLDSIAFGDEVAELENTGAILDTGTSLNVLPSGIAELLNAEIGAKKGYGGQYTIDCAKRDSLPDITFSLAGSKYSLPASDYILEVSGSCISTFQGMDFPEPVGPLVILGDAFLRRYYSVYDLGKGAVGLAKAK

SEQ ID NO: 40 - protein, 395 aa, Trichoderma aureoviride
MKSALIAAAALVGSAQAGVHKMKLQKVSLEQQLEGSSIEAQVQQLGQKYMGVRPTSRADVMFNDNLPKIKGGHPVPVTNFMNAQYFSEITIGSPPQTFKVVLDTGSSNLWVPSQSCNSIACFLHSTYDSSSSSTYKKNGSDFEIHYGSGSLTGFISNDVVTIGDLKIKGQDFAEATSEPGLAFAFGRFDGILGLGYDTISVNGIVPPFYQMVNQKLLDEPVFAFYLGNSDEGSVATFGGVDESHFSGKIEYIPLRRKAYWEVDLDSIAFGDEVAELENTGAILDTGTSLNVLPSGIAELLNAEIGAKKGYGGQYTIDCAKRDSLPDITFSLAGSKYSLPASDYILEVSGSCISTFQGMDFPEPVGPLVILGDAFLRRYYSVYDLGKGAVGLAKAK

SEQ ID NO: 41 - protein, 398 aa, Aspergillus niger
MKSASLLTASVLLGCASAEVHKLKLNKVPLEEQLYTHNIDAHVRALGQKYMGIRPSIHKELVEENPINDMSRHDVLVDNFLNAQYFSEIELGTPPQKFKVVLDTGSSNLWVPSSECSSIACYLHNKYDSSASSTYHKNGSEFAIKYGSGSLSGFISQDTLKIGDLKVKGQDFAEATNEPGLAFAFGRFDGILGLGYDTISVNKIVPPFYNMLDQGLLDEPVFAFYLGDTNKEGDESVATFGGVDKDHYTGELIKIPLRRKAYWEVELDAIALGDDVAEMENTGVILDTGTSLIALPADLAEMINAQIGAKKGWTGQYTVDCDKRSSLPDVTFTLAGHNFTISSYDYTLEVQGSCVSAFMGMDFPEPVGPLAILGDAFLRKWYSVYDLGNSAVGLAKAK

SEQ ID NO: 42 - protein, 398 aa, Aspergillus fumigatus
MKSTSLLTASVLLGSASAAVHKLKLNKVPLDEQLYTHNIDAHVRALGQKYMGIRPNVHQELLEENSLNDMSRHDVLVDNFLNAQYFSEISLGTPPQKFKVVLDTGSSNLWVPGSDCSSIACFLHNKYDSSASSTYKANGTEFAIKYGSGELSGFVSQDTLQIGDLKVVKQDFAEATNEPGLAFAFGRFDGILGLGYDTISVNKIVPPFYNMLDQGLLDEPVFAFYLGDTNKEGDNSEASFGGVDKNHYTGELTKIPLRRKAYWEVDFDAIALGDNVAELENTGIILDTGTSLIALPSTLADLLNKEIGAKKGFTGQYSIECDKRDSLPDLTFTLAGHNFTIGPYDYTLEVQGSCISSFMGMDFPEPVGPLAILGDAFLRKWYSVYDLGNNAVGLAKAK

SEQ ID NO: 43 - protein, 398 aa, Aspergillus clavatus
MKTVSLLTASALLGCASAEVHKLKLNKVPLEEQLYTHNIDAHVRALGQKYMGIRPNIHKELLEENSFNDMSRHDVLVDNFLNAQYFSEIELGTPPQKFKVVLDTGSSNLWVPSSECGSIACYLHTKYDSSASSTYKKNGTEFAIRYGSGELSGFVSQDNLKIGDLKIEKQDFAEATNEPGLAFAFGRFDGILGLGYDTISVNKIVPPFYNMLNQGLLDEPVFAFYLGDANKEGDSSVATFGGIDKDHFTGELTKIPLRRKAYWEVDLDAIALGDNVAELDNTGVILDTGTSLIALPSTLADLLNKEIGAKKGFTGQYSVECDKRDSLPDLTFTLSGHNFTIGPYDYTLEVQGSCISSFMGMDFPEPVGPLAILGDAFLRKYYSVYDLGNHAVGLAKAK

SEQ ID NO: 44 - protein, 396 aa, Nectria haematococca
MKSALLAAAALLGSAQAGVHKMKIQKVPLAEQLATTSIETHIQNLGQKYLGSARPKNQADYAFSTEAINVEGGHPVPISNFMNAQYFSEITIGNPPQSFKVVLDTGSSNLWVPSQECGSIACYLHSKYDSSASSTYKQNGSEFEIHYGSGSLSGFISNDDVSIGDLKIKGQDFAEATKEPGLAFAFGRFDGILGLGYDTISVNHIVPPFYQMVNQKLLDDPVFAFYLADQEGESEVVFGGVDKSHYEGDIEYIPLRRKAYWEVDLDAIALGDEVAEQENTGAILDTGTSLNVLPSALAELLNKEIGAKKGYNGQYTVECDKRQTLPDITFTLAGSNYSLPATDYILEVSGSCISTFQGMDFPEPVGPLVILGDAFLRRYYSVYDLGKNAVGLARSK

SEQ ID NO: 45 - protein, 399 aa, Glomerella graminicola
MKSTLLTAAVLLGAAQAEVHKLKLKKVPLEEQLNAVPIEHQVRQLGQKYMGTRPNNHADAMFNQKPIQTDGEHPVPVSNFMNAQYFSEIQIGTPPQTFKVVLDTGSSNLWVPSQQCGSIACYLHTKYDSSASSTYKSNGSSFEIHYGSGSLTGFVSQDDVSIGDLKIKKQDFAEATSEPGLAFAFGRFDGILGLGYDTISVNKIVPPFYNLVNQKAIDEPVFAFYLGDTNEEGDESEATFGGLDESHYEGKVTYIPLRRKAYWEVDLDAISLGDETADLEGHGAILDTGTSLNVLPSALAELLNKEIGAKKGYNGQYSVECSKRDELPDITFTLAGYNFSISAYDYVLEVSGSCISTFQGMDFPEPVGPLVILGDAFLRRWYSVYDLGKNAVGLAKAKK

SEQ ID NO: 46 - protein, 395 aa, Cordyceps militaris
MKSALIAAAVLAGSAHAGIHKMKLQKIPLAEQLVGASFEAQAQQLGQKYLGARPASRADIIFNAKVAESKNGHLVPVSNFANAQYFSEITIGTPPQTFKVVLDTGSSNLWVPSQSCSSIACFLHSTYDSSSSSTYKKNGSDFEIHYGSGSLTGYVSNDVVRIGDLTIKNTDFAEATNEPGLAFAFGRFDGILGLGYDTISVNHMVPPFYQMIKQKLLDEPVFAFYLGSEEEGSEAVFGGVDKNHYEGKIEYLPLRRKAYWEVDFDAIAFGKEVAELENTGVILDTGTSLNTLPSDLAELLNKEIGAKKGFGGQYTIDCAARDKLPDITFTLAGSNYTLPATDYILELGGSCVSTFTPLDMPPPAGPLAILGDAFLRRYYSVYDLNKNAVGLARAK

SEQ ID NO: 47 - protein, 396 aa, Gibberella zeae
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGAKKGYNGQYTIECDKVSSLPDITFTLAGSNYSLPSTDYILEVQGSCISTFQGMDFPEPVGPLVILGDAFLRRYYSVYDLGKNAVGLARAK

SEQ ID NO: 48 - protein, 395 aa, Metarhizium anisopliae
MKSALIAAAALAGTAHAGVHKMKLQKISLEEQLAGASIEQHVRALGQKYLGARPASRASVMFNTKAPQVAEGHPVPVSNFMNAQYFSEITVGTPPQTFKVVLDTGSSNLWVPSQSCSSIACYLHSTYDSSSSSTYKKNGSSFEIRYGSGSLSGFVSQDVVTIGDLKIKDQDFAEATSEPGLAFAFGKFDGILGLGYDTLSVNKIVPPFYQMINQKLLDEPVFAFYLGSSEEGSEAVFGGIDKDHYTGKIEYIPLRRKAYWEVDIHSIAFGDDVAELDRTGAILDTGTSLNVLPSTLAELLNKEIGAKKSWNGQYTVDCAQIKSLPDIVFNLAGSNYSLPASDYILELQGTCISTFQGMDIPEPAGPLIILGDAFLRRYYSIYDLGRNAVGLARSK

SEQ ID NO: 49 - protein, 396 aa, Fusarium oxysporum
MKGALLTAAALLGSAQAGVHKMKLNKVPLADQLATNSVEDHLQSLGQKYLGASRPKNAADYAFATNTVNVEGGHPVPVSNFMNAQYFSEITIGTPPQSFKVVLDTGSSNLWVPSQQCGSIACYLHSKYDSSASSTYKENGTEFEIHYGSGSLSGFVSNDVVSIGDLEIKDQDFAEATKEPGLAFAFGRFDGILGLGYDRIAVNGMVPPFYQMVNQKLLDEPVFAFYLDDQEGESEATFGGIDKSKFTGDIEYIPLRRKAYWEVDLEAIAFGDEVAEQENTGAILDTGTSLNVLPSALAELLNKEIGAKKGYNGQYTIECDKRASLPDITFNLAGSNYSLPATDYILEVQGSCISTFQGMDFPEPVGPLVILGDAFLRRYYSVYDLGKNAVGLARAK

SEQ ID NO: 50 - protein, 395 aa, Metarhizium acridum
MKSALIAAAALAGTAHAGVHKMKLQKISLKEQLADAPIEQHVQALGQKYIGARPPSRASVMFNTKAPQVAGGHPVPVSNFMNAQYFSEITIGSPPQSFKVVLDTGSSNLWVPSQSCNSIACYLHSTYDSSSSSTYKKNGSSFEIRYGSGSLSGFVSQDVVSIGDLKIEHQDFAEATSEPGLAFAFGKFDGILGLGYDTLSVNKIVPPFYQMIDQKLLDEPVFAFYLGSKEEGSEAVFGGIDKNHYTGELEYLPLRRKAYWEVDINSIALGDEIAELDHTGAILDTGTSLNVLPSTLAELLNKEIGAKKSWNGQYTVDCDKIKSLPDIVFNLSNSNYSLPASDYILELQGTCLSTFQGMDIPEPAGPLVILGDAFLRRYYSVYDLERNAVGLARAK

SEQ ID NO: 51 - protein, 398 aa, Verticillium dahliae
MKSTLIAAALLGSASAEIHKLKLKKVPIEEQLTSVPIETQVQQLGQKYMGVRPQSHADYMFNSKPVQSDGNHNVPVSNFMNAQYFSEITIGTPPQTFKVVLDTGSSNLWVPSQQCSSIACYLHTKYDSSDSSTYKANGSEFEIHYGSGSLTGFVSQDTVTIGDIKIKNQDFAEATSEPGLAFAFGRFDGILGLGYDTISVNKIVPPFYQMVNQKAVDEPVFAFYLGDTNEQGDESEVVFGGVDESHYEGKITTIPLRRKAYWEVDLDSISLGDNTAELDGHGAILDTGTSLNVLPSTLADMLNNEIGAKKGYNGQWSVECDKRASLPDITFNLAGYNFSISAYDYILEVSGSCISTFQGMDFPEPVGPLVILGDAFLRRWYSIYDLGKNTVGLAKAKK

SEQ ID NO: 52 - protein, 398 aa, Botryotinia fuckeliana
MKGAFLAAASLLGSVSAGVHKMPLKKVSLSEQLATANMQEHAKHLGQKYMGVRPESHASEMFKETSVHDAGDHTVPVSNFLNAQYFSEITIGTPPQSFKVVLDTGSSNLWVPSSQCGSIACYLHTKYDSSSSSTYKQNGTSFEIRYGSGSLSGFTSKDVMTIGDLKIKDQVFAEATEEPGLAFAFGRFDGILGLGYDTISVNSIVPPFYSMVDQGLLDEPVFAFYLGSNDESDPSEAIFGGVNKDHYDGKITEIPLRRKAYWEVDLDSIAFGDSEAELENTGVILDTGTSLIALPADLAGLLNAEIGAKKGWNGQYTVDCAKRDSLPELTFTLSGHKFPIGPYDYILEVQGSCISAIMGMDFPEPVGPLAILGDAFLRRYYSIYDLGKNTVGLAKAKA

SEQ ID NO: 53 - protein, 396 aa, Chaetomium globosum
MKGALLTAAVLLGSAQGAVHKMKLQKVPLSEQLEAVPLNTQLEQLGQKYMGVRPRQSHANAVFNGMVAEVKGNHPVPISNFMNAQYFSEITIGSPPQTFKVVLDTGSSNLWVPSVECGSIACYLHTKYDSSASSTYKKNGTNFEIRYGSGSLSGFVSQDTMTIGDITIKGQDFAEATSEPGLAFAFGRFDGILGLGYDTISVNGIVPPFYKMLEQKLIDEPVFAFYLADEKGQSEVVFGGVDSDKYKGKITTIPLRRKAYWEVDFDAISYGDDTAELENTGVILDTGTSLIALPSQLAEMLNAQIGAKKNYAGQYAIDCNKRDSLKDVTFNLAGYNFTLGPYDYILEVSGSCISTFMGMDFPEPTGPLAILGDAFLRRYYSIYDLGANTVGLAEAK

SEQ ID NO: 54 - protein, 396 aa, Thielavia terrestris
MKGALLTAAVLLGSAQGAVHKLKLQKIPLAEQLESVPIQTQLEHLGQKYMGLRPKQSHASAVFNGMPVEVEGNHPVPISNYMNAQYFSEITLGTPPQSFKVVLDTGSSNLWVPSVECGSIACYLHSKYDSSASSTYKKNGTSFDIRYGSGSLSGFVSQDTLSIGDITVKGQDFAEATSEPGLAFAFGRFDGILGLGYDTISVNGIVPPFYKMVEQKLVDEPVFAFYLADTNGESEVVFGGVDKDRYKGKITTIPLRRKAYWEVDFESLSYGDDTADFENTGAILDTGTSLITLPSQLAEMLNAQLGAKKNFAGQYVLDCSKRDSLEDITFNLAGYNFTLGPQDYILEISGSCMSTFTPMDFPAPTGPLAILGDAFLRRYYSIYDLGANTVGLAEAN

SEQ ID NO: 55 - protein, 395 aa, Magnaporthe oryzae
MKGAMMTAAVLLGTAEAGVHKLKMKKIPLEDQLKTFDLNAQMRGLGQKYLGIRPESHQQAVFSNDAVQASGNHPVPISNFMNAQYFSEITIGTPPQNFKVILDTGSSNLWVPSSSCGSIACYLHNKYESSSSSTYKKNGTEFKIQYGSGSMEGFVSNDVMTIGDLKIKNLDFAEATKEPGLAFAFGRFDGILGMGFDRLSVNKIVPPFYAMVDQKLIDEPVFAFYLADEKSESEVVFGGVNKDHIDGKITEIPLRRKAYWEVDLDAIALGDEVAELDNTGVILDTGTSLIALPSQLAELLNSQIGAKKGYNGQYSIDCDKRKDLPDITFRLSGYDFPISAYDYILEVSGSCISTFMAMDIPEPVGPLAILGDAFLRRYYSIYDLGKGTVGLAKAK

SEQ ID NO: 56 - protein, 396 aa, Tuber melanosporum
MKSSIIFAAGSLLGSAMAGVHRAPLKKVPLTEQLSHHDINTQMRALGQKYMGIRPEKIDEEMFKTQEIKTDDGHPVPVSNFLNAQYFSEITIGTPPQTFKVVLDTGSSNLWVPSSQCGSIACYLHSKYDSSTSSTYRPNGTSFEIRYGSGSLSGFVSQDNIEIGNLKIKDQTFAEATSEPGLAFAFGRFDGILGLGYDSISVNHIVPPFYQMVDQGLLDEPVFAFYLGDKDDQSEAIFGGIDKAHYQGKLIKLPVRRKAYWEVEFEAITFGKSTAQFENTGAIVDTGTSLIALPSTLAELLNKEIGAKKGFNGQYSVECEKRDSLPDLTFTLTGHDFTITAYDYILEVQGSCISAFMGMDFPEPIGPLAILGDAFLRRYYSVYNLGDNTIGLAKSK

SEQ ID NO: 57 - protein, 396 aa, Neurospora crassa
MKGALLTAAMLLGSAQAGVHTMKLKKVPLAEQLESVPIDVQVQHLGQKYTGLRTESHTQAMFKATDAQVSGNHPVPITNFMNAQYFSEITIGTPPQTFKVVLDTGSSNLWVPSSQCGSIACYLHNKYESSESSTYKKNGTSFKIEYGSGSLSGFVSQDRMTIGDITINDQLFAEATSEPGLAFAFGRFDGILGLGYDRIAVNGITPPFYKMVEQKLVDEPVFSFYLADQDGESEVVFGGVNKDRYTGKITTIPLRRKAYWEVDFDAIGYGKDFAELEGHGVILDTGTSLIALPSQLAEMLNAQIGAKKSWNGQFTIDCGKKSSLEDVTFTLAGYNFTLGPEDYILEASGSCLSTFMGMDMPAPVGPLAILGDAFLRKYYSIYDLGADTVGIATAKR

SEQ ID NO: 58 - protein, 426 aa, Trichoderma reesei
MKFHAAALTLACLASSASAGVAQPRADEVESAEQGKTFSLEQIPNERYKGNIPAAYISALAKYSPTIPDKIKHAIEINPDLHRKFSKLINAGNMTGTAVASPPPGADAEYVLPVKIGTPPQTLPLNLDTGSSDLWVISTDTYPPQVQGQTRYNVSASTTAQRLIGESWVIRYGDGSSANGIVYKDRVQIGNTFFNQQAVESAVNISNEISDDSFSSGLLGAASSAANTVRPDRQTTYLENIKSQLARPVFTANLKKGKPGNYNFGYINGSEYIGPIQYAAINPSSPLWEVSVSGYRVGSNDTKYVPRVWNAIADTGTTLLLVPNDIVSAYYAQVKGSTFSNDVGMMLVPCAATLPDFAFGLGNYRGVIPGSYINYGRMNKTYCYGGIQSSEDAPFAVLGDIALKAQFVVFDMGNKVVGFANKNTNV

SEQ ID NO: 59 - protein, 417 aa, Trichoderma virens
MKFHAAALTLAYLANSASASVAQPRSEAAQAPEDGKTFSITQIQNERFRGPNVPASYIAALAKYSPQVSEHIKHAIRLVEETGNQTGTAVATPAPGADSEYVLPVKIGTPPQTVPLNLDTGSSDLWVLSTDTYPSQIQGQAIYDPNASNTSRRQTGLSWLIRYGDGSSANGIVYKDRVQIGNTFFDQQAIESAIRVSDDISDDTFASGLLGAAGSAGNTVRPDKQKTYLDNIKDQLAKPLFTANLKKGKPGNYNFGYINASEYTGDIQYAAINPKGPLWEISVSGYRVGSDESKYVSRVWNAIADTGTTLLLTPTDIVNAYYAQVNGSTMNDDVGMMVVPCTAKLPDFVFGLGKYRGVIPGTYMNYGRMNRTYCYGGLQDSEGAPFAVLGDIALKAQFVVFDFGNNVVGFANKNTTV

SEQ ID NO: 60 - protein, 543 aa, Trichoderma atroviride
MEYALNASTAIHAEYHSSVAVVRGLHARVCLSNVSVVPSMITMKEMKMCLRKFVVSPVELQHFPQAIELEQSFPHAHALGSIPGQVFGRIITGVGQDIDMSEGGLQHSFHQIATALNLIMKFHATSLAIACLASSASAAVAQPKGTAETTPQGEEFSITQIRNERWKGPNAPAAYIAALAKYSPTIPDSIKHAIRVNPGLRQKFGKLINAGNQTGTGVATPSPGGDAEYVLPVQIGTPPQTLPLNLDTGSSDLWVLSTDTYPSQVEGQPLYKPNNSTTSKRLPGESWVIQYGDGSSANGIVYTDRVQIGNTFFNTQAIESAINVSDEISDDTFSSGLLGAAFSTANTVRPDQQKTYLDNIKDQLVKPVFTANLKKGKPGNYNFGYINASEYTGNIQYAAIKPRSPLWEISVSGYRVGSNDTNYVARVWNAIADTGTSLLLAPVDIVNAYYKQIAGSKLDSGYGMMVFPCNTTLPDFVFGLGTYRGVIPGSYINYGKINRTYCFGGIQSSEDAPFAVLGDILLKAQFAVFDMGNKVVGFANKPV

SEQ ID NO: 61 - protein, 446 aa, Metarhizium acridum
MKATIAAIVLALLAEGAVVGERVDAAPQAPAPRTNGRSFTLHQVVNNNFQGHDGPTSFLRAHFKYAQKLPDYLSKLVEINPNFRIKFGAASQGKCYPEVTLWQVLSLLLTSIIAGEQVGTVEANPSPLVDTEYAVEIGIGTPPQRIRLNLDTGSSDFWVFSTDTTPSMVHDQGLYNANKSTTSHFLTGESWKIKYGDNASASGYVYTDRVQIGETYVDTQAVQVAVNVTEDLSEDKFVSGILGMANSAANTVRPTPQRTYIDNIKNDLALPLFTANLQRQAPGSYNFGYIDDFEYTGDISYTPIERTFPLWMVHTTGYRIGKTSHDKSINAIVDTGTSLLLLPETVVSNYYAKVKGSSVDPRLGMRVVPCNANLPDFYLTIGSYRGRVPGSYMNYGRVSGNSCFGGIQSSDALPFSVLGDVFLKTQFVVFDYGNARVGFARKNLYE

SEQ ID NO: 62 - protein, 560 aa, Fusarium oxysporum
MKFSTVSFLLLAGCSTGIPHEIRGDVYEVKNPFSPNAVDPEVEGVKGLQKRTIDPKGDQALVARGDVYEVKNPFSPNAVDPEVEGVKGLQDRDIKPRDVSNNDPLEARGDIYEVKNPFSPNAVDPEVEGVKGLQERDIDPEEQEEEELGKTLRGRAIDHENDPDSAHLKPRAGGEKVKMDQLTNTRYKKPHAEIALIQAYNKYHKPLPPKLKKIAQHEADLIKNKLGMKGTASATPPQYYDSQYVVPVKIGTPAQQTYLNFDTGSSDLWVFSTDTYQPDQAGHILYKPDKSTTSKRLNGQTWSIRYGDGTGASGIVYTDKVQVGKTYVNKQAVESATEVSDGIASDKFSHGIMGLAMSSLNTVRPTPQNTYFQNVQNNLAVPVFTANLQKGKAGNYNFGYIDQGEYYGSIQFAKVKKGSPWWQINIEGYRIAAGAPWHKYNYSAIVDTGTTLLLLPGVLTNFYYRKVKGAYIDQDYGVWVFPCTSKLPSFYFGFGSYQGKVPGNYINYGRLTNTVCYGGIQSSDGIGFAILGDILLKAQFVVFDLKGQRVGFANKLTIKS

SEQ ID NO: 63 - protein, 432 aa, Cordyceps militaris
MKTTTLTAALALATTGYSAAQWSPVSSAATGANARFSLQQMYNDKFKGVNPTDALLRAYSRYATFVPDHIQALVDKEPSLKATFHALFSGTETHALKTVHAEAAPPSDVDSEYVLPVSLGTPPQILPLNLDTGSSDFWVFSTATPQDELRGQKIYYPQNSTTSKTLPGEHWKIRYGDNSTANGDVYIDRAAIGPVGFDKQAIQVATAISSSIAEDGFFSGILGMASSYANTVKPTKQVTFLDNIKDTLDAPVFTANLQKGMSGNYNFGYIDASEHTGDIAYTPINTNSSFWEVELSGYQFGQDAFKNERVVGIVDTGTTLLLFPQHVVDEYYGKLPGSFFDKQSATMVFPCDLTPPDFFFGVGNDYRGRIPGHYMNYAHQSAKYCYGGLQSAKGIPFCIFGDILLKAQFVVFDRGNLSVGFANKKTVPAPQS

SEQ ID NO: 64 - protein, 480 aa, Gibberella zeae
MRFSTVSFLLLAGCSTGIPHEIRGGHEVNGASVDHPEKPLGRAERRSTDLQVDGSRALTVRSDAYEDPIDGTEEEDIDLEELEEIEMGKGLKGRAIDPETDPDSAHLKPHAEIALIHAYNKYRKPLPNQELKKIAAQEEAFVKNKLGMKGTAAATPPQYYDSQYVVPVQIGSPQQTTYLNFDTGSSDLWVFSTDTYQPDQAGHILYKPDKSTKCKRLNGQTWSIKYGDGTGASGIVYLDTVRVGKTYVNQMAVQSATEVSDGIASDTFAHGILGLAMSSLNTVRPTAQKTYFERVQGALEVPIFTANLKKGSAGNYNFGYLDQSEYYGSVGFAAVKKDSPWWQITVEGFRVAQGAPWHKYKYSAIVDTGTTLLLLPDYLVKFYYKKVKGAYIDNDYGVWVFPCTAKLPSFYFGFGNYRGKVPGHYINYGRLTSTVCYGGIQTSEGIGFAILGDILLKAQFVIFDLKGNRVGFANKNTVKA

SEQ ID NO: 65 - protein, 432 aa, Verticillium dahliae
MHYLTYLNCLAAVAAASPLAVAEPANIDGSTFTLRQVENKDFAGQTGLDELVWAYIKYNAELPAKVREAIVIGKHVNARFKGLVQRGTTDDKSASFGTVQAFPPRNVDIQYVVPVQIGSPPQTVFLNLDTGSGDLWTFSSETPEWQRGDHRIYSPELSNTSVLQDGLTWRITYGDGSGASGNVYNDRVALGKTSFAAQAIESASQVSPSFTRDSFASGILGLGFGRGNTVKPRPVKTYFENVMPALASPVFTSNLQAGRPGNYNFGFVARNEYTGRIGYTPVTKRNPYWEIKVDGTQIGGGEYNRTTTLDRVIVDTGTTLLMLPDEHVDAYYDQVEGARFSPSWAAYLFPCDATLPDWTFGLGDYRGKLPGRYVRYNQVNETHCFGGIQSSAGIPFAIFGAALLKAQFAVFDYVEADREVQPRVGFANKPLR

SEQ ID NO: 66 - protein, 259 aa, Trichoderma reesei
MAPASQVVSALMLPALALGAAIQPRGADIVGGTAASLGEFPYIVSLQNPNQGGHFCGGVLVNANTVVTAAHCSVVYPASQIRVRAGTLTWNSGGTLVGVSQIIVNPSYNDRTTDFDVAVWHLSSPIRESSTIGYATLPAQGSDPVAGSTVTTAGWGTTSENSNSIPSRLNKVSVPVVARSTCQADYRSQGLSVTNNMFCAGLTQGGKDSCSGDSGGPIVDANGVLQGVVSWGIGCAEAGFPGVYTRIGNFVNYINQNLA

SEQ ID NO: 67 - protein, 255 aa, Trichoderma atroviride
MAPASAVVSALMLPALALGAAIEPRGAEIVGGTTAAAGEFPYIVSLSSGGSHFCGGVLANANTVITAGHCSVDFSASQVKVRAGSLTWASGGTQVGVSSITVNPSYTTKNGVPDFDVAVWKLSTPIQTSSTIGYVTLPASGSDPAAGTTLTTAGWGTTSENSNSLPSRLNKVSVPVISRASCNSEYGNIISNNMFCAGLSQGGKDSCSGDSGGPIVDSNGVLQGLVSWGQGCAEAGFAGVYVRLGNLLSFVNSHL

SEQ ID NO: 68 - protein, 254 aa, Trichoderma virens
MAPVSQVVSALMLPALALGAAIEPRGADIVGGTAAALGEFPYIVSLSTQGSHFCGGVLVNANTVVTAAHCSVDFTASQVKVRAGTLTWASGGTQVGVSKIIVNPSYNSRTTDFDVAVWKLASSIPQSSTIGYATLPAAGSDPAAGSIVTTAGWGTTSEGSSSLPARLNKVSIPVVSRATCQSEYGRSAITTNMFCAAQAQGGKDSCQGDSGGPIVDANGVLQGLVSWGNGCAEAGFAGVYSRLGALLSFVQANL

SEQ ID NO: 69 - protein, 254 aa, Hypocrea lixii
MAPVSQIVSALMLPALALGAAIEPRGADIVGGTAAALGEFPYIVSLSTQGSHFCGGVLVNANTVITAAHCSVDFSASQVKVRAGTLTWASGGTQVGVSRIIVNPSYNSRTTDFDVAVWKLASSIPESSTIGYATLPAAGSDPAAGSIVTTAGWGTTSEGSSSLPARLNKVSVPVVSRATCQSEYGRSAVTTNMFCAAQAQGGKDSCQGDSGGPIVDANGVLQGLVSWGNGCAEAGFAGVYSRLGSLLSFVQANL

SEQ ID NO: 70 - protein, 258 aa, Hypocrea lixii
MAPVLAIASVLAALPALTMGAAITPRGSDIVGGTTAALGEFPYIVSLSTGGSHFCGGVLIDSRTVVTAGHCTIDQRASSVKVRAGTLTWASGGTQVGVSSLTLHPSYTVDSQGVPDNDVGVWHLATAIPTSSTIGYATLPASGSDPAAGTTLTVAGWGTTSENSNSLPSTLRKVSVPVVARATCDSDYDGEISNNMFCAAVAAGGKDSCSGDSGGPIIDPSGTLVGVVSWGQGCAERGFPGVYTRLGNYVSFINSNRG

SEQ ID NO: 71 - protein, 271 aa, Sclerotinia sclerotiorum
MAPILNFALALAMPILSMAAALPSGTELENRGTTLTGTVGIVGGTTAALGEFPYIVSLTYAGSHFCGGVLLNAYTVLTAAHCSVSYSASSVKVRAGTLTWASGGTQVGVSKVVVHPSYNSRTIDNDIALWHLSTAIPSSSTIGYAKLPVQGSDPVVGSTATVAGWGLLTENSSSLPATLRKVSVPVISRSTCQAEYGTSSVTTNMWCAGVTGGGKDSCSGDSGGPIIDAATGVLEGTVSWGQGCAEAGYAGVYSRVGNYVTYIQSSLWTSL

SEQ ID NO: 72 - protein, 271 aa, Botryotinia fuckeliana
MAPILNFALALAMPILSLAAALPTGAELENRATTLGGTPDIVGGTTAALGEFPYIVSLSYSGSHFCGGVLLNAYTVLTAAHCSVSYSASSVKVRAGTLTWASGGTQVGVSKVVVHPSYSSSTTNNDIALWHLSTALPASSTIGYAKLPVQGSDPVVGSTTTVAGWGLLTENGSTLPSTLRKVSVPVISRASCQAEYGTSAVTTNMWCAGYAAGGKDSCSGDSGGPIIDTATGVLEGTVSWGQGCAEAGYAGVYARVGNYVTYINSNLWTSL

SEQ ID NO: 73 - protein, 263 aa, Phaeosphaeria nodorum
MHAQSILAALAVPALVYGAAIPQEFPENWDETSEDIVGGVTAAQGDVPFIVSVSLSGVGHYCGGSLINANTVVSAAHCYQGETATDFSVRAGSLNKNSGGTTSAVASIVIHPSYNSRTSDNDIAIIKLRTPIATSSTISYASLAASGQDPAAGTTLTVAGWGATTQGGGSPTTLRKVDVPVVARTTCRSRYSTIGLSVTDQMFCAGFTAGGKDSCQGDSGGPIITSSKQLVGIVSWGEGCAQPNFPGVYSRVGSLTSFISANL

SEQ ID NO: 74 - protein, 265 aa, Leptosphaeria maculans
MQIKDLVVALAVPAICIAAAIPTPQDPVETEFPEESQEDIVGGTAAAAGEFPYIVSLQRSGSHFCGGSLLNGNTVVTAAHCAVGLSGTAVTVRAGSNSRTSGGVTARSSSIVINPGYSSSTFDGDVAIIKLSTSIPTSNTISYVSLPAAGSDPAAGSVATVAGWGTLTSGSQSLPVNLQKVDVPIVSRTTCRSNYGQSAITNNMICAGLTQGGKDSCQGDSGGPIVSSSKQLIGLVSWGDGCAAPGKPGVYTRVAAVLSFINANS

SEQ ID NO: 75 - protein, 256 aa, Verticillium dahliae
MVFKTLVAALGFTAVAFGSPVPAPQEELQIVGGVAASAGDFPFIVSLQRSGSHFCGGSLLNANTVLTAAHCSTGVSASSVTVRAGSLNRSSGGTLVRVSSIVVNPGYVASRYDNDFAIWKLATPIPTSSTISYATLAAANSDPAANTLTTTAGWGTTSSGGSTLPTALRKVDVPIISRTTCRSYYGTSAVTTNMICAGFAAGGKDSCQGDSGGPIIEASSRTLVGVVSWGEGCAAPNAPGVYARVGAARTFINQYL

SEQ ID NO: 76 - protein, 261 aa, Cochliobolus carbonum
MRFQSMITAALPALVLSAPTPQWDDVPEDSIVGGTTAAAGEYPFIVSIQLGGRHNCGGTLINGNTVVTAAHCSVSSAIGGSINNVAVRVGSLSANSGGQVIKVSKIIIHPSYQASTSNNDIAIWKLSSTVTAGGNIGFASLAASGSDPASGSTTSVAGWGATREGGGANNALLKVSVPIVARSTCVSNYNAVGLTVTTNMVCAGVTAGGRDSCQGDSGGPLVDANKTLIGVVSWGTGCARPNLPGVYSRVGTLRSFIDQNA

SEQ ID NO: 77 - protein, 257 aa, Metarhizium acridum
MVSRSAIAIASAVFAVQSATAAPAKGGKFIVGGQAANEGEFPFIVTVLLNGTHYCGGTLVNEDTVVTASHCTKSDVSGYEIRAGSLAWASGGTKVKVASAVRHPGYNSTNYDNDVAVWKLATPIPESSTIQYAKLPAQGSDPASGSNATVAGWGRLTEGGTVPARLQKVTVPVVDRGTCKVAYSTPTPSEVTENMFCAGLEQGGQDACQGDSGGPIVDTATGALIGVVSWGVGCARPDKYGVYTRLGNYVDFVEKYL

SEQ ID NO: 78 - protein, 255 aa, Metarhizium anisopliae
MASKAALAIASAIFAVQSATAAPAKNGKFIVGGEAAAQGEFPYIVALLSGNFQFCGGTLVNEDTVVTAGHCTSSDVSGIEVRAGSLAWASGGTKVKVRSATRHPDYNGNNYDNDVAVWKLATAIPQSATIKYAKLPAPDSDPAPGANVTVAGWGRLQEGGATPSQLQKVTVPVVDRATCKEAYSTPTPLEITDNMFCAGLPQGGQDACQGDSGGPIVQGDVLLGVVSWGVGCARPNKYGVYTRLGNYVSFIEQYL

SEQ ID NO: 79 - protein, 248 aa, Fusarium oxysporum
MVKFASVVALVAPLAAAAPQEIPNIVGGTSASAGDFPFIVSISRNGGPWCGGSLLNANTVLTAAHCVSGYAQSGFQIRAGSLSRTSGGITSSLSSVRVHPSYSGNNNDLAILKLSTSIPSGGNIGYARLAASGSDPVAGSSATVAGWGATSEGGSSTPVNLLKVTVPIVSRATCRAQYGTSAITNQMFCAGVSSGGKDSCQGDSGGPIVDSSNTLIGAVSWGNGCARPNYSGVYASVGALRSFIDTYA

SEQ ID NO: 80 - protein, 252 aa, Gibberella zeae
MVKITSLVALAAPLVAAAPNPQNSPQIVGGTSASAGEFPFIVSITNNGGPWCGGTLLNANTVMTASHCVQGRSASAFAIRVGSNSRTSGGVTSRVSSIRMHPSFSGSTLNNDVALLKLSTSIPAGGSIAYGRLATSGSDPAAGSSLTVAGWGDTSEGGGVSPVNLLKVTVPVVSRATCRSQYGTSAITDNMFCAGVTGGGKDACQGDSGGPIVDSSKTVVGIVSWGDGCARPNAAGVYARVGTLRSWIDSNA

SEQ ID NO: 81 - protein, 256 aa, Metarhizium anisopliae
MELKSLLAVYLPLCAAPLAAARPASNAVFIVGGSPAAAGEFPFIVSTLLNGRHWCGGVLLNANTVLTAAHCVESTPAISQVRAGSLAHASGGVVANISSITPHPKYEGLGYDMAILKLSTPIEANGTIGYATLPEAGSDPVAGADATVAGWGDLEYAGQAPEELQKVTVPVVDRATCSAAYQAIPNMPNITDAMFCAGLKEGGQDACNGDSGGPIIDTETRVLIGVVSWGYKCAAPNAYGVYTRLGADIEFIKSHL

SEQ ID NO: 82 - protein, 882 aa, Trichoderma reesei
MVRSALFVSLLATFSGVIARVSGHGSKIVPGAYIFEFEDSQDTADFYKKLNGEGSTRLKFDYKLFKGVSVQLKDLDNHEAKAQQMAQLPAVKNVWPVTLIDAPNPKVEWVAGSTAPTLESRAIKKPPIPNDSSDFPTHQMTQIDKLRAKGYTGKGVRVAVIDTGIDYTHPALGGCFGRGCLVSFGTDLVGDDYTGFNTPVPDDDPVDCAGHGSHVAGIIAAQENPYGFTGGAPDVTLGAYRVFGCDGQAGNDVLISAYNQAFEDGAQIITASIGGPSGWAEEPWAVAVTRIVEAGVPCTVSAGNEGDSGLFFASTAANGKKVIAVASVDNENIPSVLSVASYKIDSGAAQDFGYVSSSKAWDGVSKPLYAVSFDTTIPDDGCSPLPDSTPDLSDYIVLVRRGTCTFVQKAQNVAAKGAKYLLYYNNIPGALAVDVSAVPEIEAVGMVDDKTGATWIAALKDGKTVTLTLTDPIESEKQIQFSDNPTTGGALSGYTTWGPTWELDVKPQISSPGGNILSTYPVALGGYATLSGTSMACPLTAAAVALIGQARGTFDPALIDNLLATTANPQLFNDGEKFYDFLAPVPQQGGGLIQAYDAAFATTLLSPSSLSFNDTDHFIKKKQITLKNTSKQRVTYKLNHVPTNTFYTLAPGNGYPAPFPNDAVAAHANLKFNLQQVTLPAGRSITVDVFPTPPRDVDAKRLALWSGYITVNGTDGTSLSVPYQGLTGSLHKQKVLYPEDSWIADSTDESLAPVENGTVFTIPAPGNAGPDDKLPSLVVSPALGSRYVRVDLVLLSAPPHGTKLKTVKFLDTTSIGQPAGSPLLWISRGANPIAWTGELSDNKFAPPGTYKAVFHALRIFGNEKKKEDWDVSESPAFTIKYA

SEQ ID NO: 83 - protein, 884 aa, Trichoderma atroviride
MVRSALFVSLLATITGAIARGSGHASKIVPGAYIFEFENDHDTAEFYKQLNGEGSTRMKFDYKLFKGVSVQLKDLSNHEDKAQKMAQLPAVKNMWPVTLIQAPNPKVEWVAGTNSLPSIQSRDVYPPPTDDGNFPPHKMVQIDKLRAKGYTGKGVKVAVIDTGIDYTHPALGGCYGAGCLVSFGTDLVGDNYSGFNTPVPDNDPKDCAGHGTHVAGIIAAQKNQYGFTGGAPDVTLGAYRVFGCEGQAGNDVLIAAYNKAFEDGAQIITASIGGPSGWAEEPWAVAVTRIVNAGVPCTVSAGNDGDHGLFYASTAANGKKVLAVASVDNQNIPTVFSLSSYKIDSGADTKFGYVPSSKGAEGWKGVTKPVYALTLDTTIADDGCSPLPDNTPDLSDHIVLVRRGSCTFVQKAQNVAAKGGKYLLYYNTIAGALSVEVSSVPQIIGAGMVEDSTGATWIAAIKAGKTVTLSMVALNEATKQVQFADNKATGGALSTYTSWGPTWEMDVKPQISSPGGNILSTYPVALGGYATLSGTSMACPLTAAAVALVAQARSSFDPVLLENLLATTANPQLFNDGTQFYDFLAPVAQQGGGLIQAYDAAFATTLLSPSSLSFNDTDHFISKRQITLKNTSKNRVTYKIGHVPTDTFYTLANSSGYAAPFPNDAVASHASVRLSQQQVTVPAGRSITVDVFPTPPRGVDAKRLGLWSGYITVNGTDGSHLSVPYQGLTGSLQKQQVLFPEDSWISNSTDTNLNPVANGTVFTIPGPGNAGPSDVLPALVVSPALGTRLVRADLVLLSAPPHGSKITTKKFFDTTSIGQPSGSPLLWQSRGPTPISWSGELTDNKFAPPGTYKVVFHALRIFGNEKKKEDWYVSESPAFTIKYA

SEQ ID NO: 84 - protein, 827 aa, Trichoderma atroviride
MKFDYKLFKGVSVQLKDLSNHEDKAQKMAQLPAVKNMWPVTLIQAPNPKVEWVAGTNSLPSIQSRDVYPPPTDDGNFPPHKMVQIDKLRAKGYTGKGVKVAVIDTGIDYTHPALGGCYGAGCLVSFGTDLVGDNYSGFNTPVPDNDPKDCAGHGTHVAGIIAAQKNQYGFTGGAPDVTLGAYRVFGCEGQAGNDVLIAAYNKAFEDGAQIITASIGGPSGWAEEPWAVAVTRIVNAGVPCTVSAGNDGDHGLFYASTAANGKKVLAVASVDNQNIPTVFSLSSYKIDSGADTKFGYVPSSKGAEGWKGVTKPVYALTLDTTIADDGCSPLPDNTPDLSDHIVLVRRGSCTFVQKAQNVAAKGGKYLLYYNTIAGALSVEVSSVPQIIGAGMVEDSTGATWIAAIKAGKTVTLSMVALNEATKQVQFADNKATGGALSTYTSWGPTWEMDVKPQISSPGGNILSTYPVALGGYATLSGTSMACPLTAAAVALVAQARSSFDPVLLENLLATTANPQLFNDGTQFYDFLAPVAQQGGGLIQAYDAAFATTLLSPSSLSFNDTDHFISKRQITLKNTSKNRVTYKIGHVPTDTFYTLANSSGYAAPFPNDAVASHASVRLSQQQVTVPAGRSITVDVFPTPPRGVDAKRLGLWSGYITVNGTDGSHLSVPYQGLTGSLQKQQVLFPEDSWISNSTDTNLNPVANGTVFTIPGPGNAGPSDVLPALVVSPALGTRLVRADLVLLSAPPHGSKITTKKFFDTTSIGQPSGSPLLWQSRGPTPISWSGELTDNKFAPPGTYKVVFHALRIFGNEKKKEDWYVSESPAFTIKYA

SEQ ID NO: 85 - protein, 878 aa, Trichoderma virens
MVRSALFVSLLATISGVIARGSGHPSKVVPGAYIFEFENDQDTADFYKQLNGEGSTRMKFNYKLFKGVSVQLKDLSNHEDKAQKMAQLPAVKNMWPVTLIQAPNPKVEWVASSSSPALQARDVSPTDPSNFPPQQMTQIDKLRAKGFTGKGVKLAVIDTGIDYTHPALGGCFGAGCLVSFGTDLVGDNYSGFNTPVPDNDPMDCAGHGSHVAGIIAAQKNPYGFTGGAPDVTLGAYRVFGCAGQAGNDVLIAAYNKAFEDGAQIITASIGGPSGWAEEPWAVAVSRIVDAGVPCTVSAGNDGDHGLFYASTAANGKKVLAVASVDNANIPTVFSLSSYKVDNGDAQQFGYVSSAKAWKGVNKPIYAVTLDTTIPNDACDPLPDSTPDLSNYIVLVRRGTCTFVQKAQNVAAKGAKYLLYYNTAAGALAVDVSTVTQITAAGMVQDSTGAAWIAALKDGKTVTLSMVNSDEATKQIQFADNKVTGGALSTYTSWGPTWEVDVKPQISSPGGNILSTYPVAKGGYATLSGTSMACPLTAAAVALVGQARKTFDPVLLENLLATTANPQLFNDGAQFYNFLAPVAQQGGGLIQAYDAAFATTLLSPSSLSFNDTDHFVRKRQITLKNTSKQRVTYKLNHVPTNTFYTLTGDSPYPAPFPNDAIAAHATVRLGLEQVTLPAGRSITIDVLPTPPRGVDAKRLGLWSGYITVNGTDGSALSVPYQGLTGSLHKQKVLYPADSWISKSTDENLNPVDNGTVFTIPAPGNAQSTDVLPSLVVSPAFGSRLVRVDLVLLSAPPKNTKVKTTKFLDTTSIGQPAGSPLLWASRGATPLSWSGELTDNKFAPPGTYKAVFHALRIFGNEKKKEDWDVSESPAFTIKYA

SEQ ID NO: 86 - protein, 878 aa, Hypocrea lixii
MVRSAVFLSLLATISGVIARGSGQTSKVVPGAYIFEFENDQDTAAFYKQLNGEGSTRMKFNYKLFKGVSVQLKDLSNHESKAQKMAQLPAVKNMWPVTLIQAPNPKVEWVASSTSPALQARDVSPTDPSNFPPHQMVQIDKLRAKGYTGKGVKVAVIDTGIDYTHPALGGCFGAGCLVSFGTDLVGDNYSGFNTPVPDNDPKDCAGHGSHVAGIIAAQENPYGFTGGAPDVTLGAYRVFGCEGQAGNDVLIAAYNKAFEDGAQIITASIGGPSGWAEEPWAVAVSRIVDAGVPCTVSAGNDGDHGLFFASTAANGKKVLAVASVDNKNIPTVFSLSSYKVDNGDSQQFGYVSSSKAWKGVTKPVYAVTLDTTIPDDACSPLPDSTPDLSNYIVLVRRGTCTFVQKAQNVAAKGAKYLLYYNNIAGALSVDVSTVTQITAAGMVQDSTGAAFIAAIKAGKTVTLSMVDPDSATKQIQFADNKATGGALSTYTSWGPTWEVDVKPQISSPGGNILSTYPVALGGYATLSGTSMACPLTAAAVALVAQARGTFDPALIENLLATTANPQVFNDGAQFYDFLAPVAQQGGGLIQAYDAAFATTLLSPSSLTFNDTDHFVRKRQITLKNTSKQRVTYKLNHVPTNTFYTLSGDSPYPAAFPNEAIAAHASVKLALQTVTLPAGKSITIDVLPTPPKGVDAKRLGLWSGYITVNGTDGSALSVPYQGLTGSLHKQQVLLPEDSWIAKSTDENLNPVENGTVFTIPAPGNAQSTDVLPSLVVSPAFGSRQIRVDLVLLSAPPKNTKIKTTKFLDTTSIGQPAGAPVLWASRGPTPLSWSGELTDNKFAPPGTYKAVFHALRIFGNEKKKEDWDVSESPAFTIKYA

SEQ ID NO: 87 - protein, 885 aa, Metarhizium acridum
MVGLSLVVSLVAAAASALAADAQDKRLVKTFVPGAYIFELEDGHDPATFEQTVGKDGTTRMKLDYELFKGVSVQLHDVDKAHEKAAKLADTPAVKAVYPVQLFNMPKPKVEWIAKDGTKAPGGLLSSRADDGADIFSPHVMTQVDKLRAKGVTGKGVKIAVVDTGIDYKHPALGGCFGHGCLVAFGTDLVGDAYDGSNTPHPDPDPMDCGGHGSHVAGIVAAQPNTFGFTGAAPGATLGAYRVFGCKGQAGNDVLIAAFNQAYQDGANIITASIGGPSGWSEDPWAEAVSRIVDKGVPCTVSAGNEGAEGIFYASTAANGRRVSAIASYDNVQTPSLIYNAKYQIDNGADTKFGYVPSEPASWDGVTLPAWSNSLDPTIPDDGCDPFPANTPDLSNYIVLIRRGSCPFTQKVNNAVAKGAKYVIVYNNNAVGAIPMDLTEVPAGSIKAASMIDGTTGATFINALKDGKKLTLKMVSPQKTDSEVNTSNNTITGGALSTFTSWGPTWEMDTKPQFGAVGGNVLSTYPRALGSYAVLSGTSMSCPQTAGIIALIHEVRGTYDPELIQNLLSANANPQLFNDGTKFYDFLAPVPQQGGGLIQAYDAAYATTLLSPSSLSFNDTDHFVETLKFKLQNTESKKITYKITHTPAITMYALGDGSPSVQPFPNEAVKAVATIKLSETSVTLNGGQSKSISVSPTPPQGLDAKRLALWSGYIVINGTDGTSLSLPYQGLTGSLHKSAVLGANNTWISKSTDKQSNPVPPNSTFLIPAPGNARSNDTLPQLTAALYLGSRKVRADIVPLTTCPPKNLTTEFQGIKTIGQPYNFPALWGTRGLNNFPWDGRLDSGNYAPPGKYRFVVRALRIFGDEKKKEDWDVSTSPALHIKYQ

SEQ ID NO: 88 - protein, 882 aa, Fusarium oxysporum
MVRLSIVAALYAAVVSAVDFDKIAVGKGHSRLPGAYIFEFEENHDCADFFAKASSRGKTRMQYNYKLFKGASIQFTDIDNAEDLASEMALLPGIKQKWPVQTFSIPKPEVHWTGTPGMEYKSIQKRGFEERDAANDTFSPHVMTQIDKLRAEGVTGKGLKVALVDSGIDYKHPALGGCFGKNCLVSFGTDLVGDAYDGSNHAKPDNDPMDCAGHGTHVAGILAAQKNTMGFTGAAPGVQIGAYRAFGCNGEAGNDVLIAAFNQAFEDGADIISASIGGPSGWSEEPWAVAVSRIVEQGVPCVLAAGNAGATGMFYASTAANGKKVTAVGSFDNTKSLALLNASKYSIDGGPEHEFGHLSGKPSAWKGVKLPLWALNYDTSVADDGCDEWPKNTPDLGNYIVLLRRGSCTFDAKAANAVKAGARYIMFYSNKEDLAPFDVSSVGGIKAASIVSPEQGAEWIASLKAKKKITLSMSDGSDGNVILEQKHNNITAGAASTFSSWGPTWEMDVKPQFGAPGGKILSTYPRSMGSYAVLSGTSMASPLVAGIVALIAEARGTRDPALIENLLSASAKPQLFNDGKTFYDFLAPVPQQGGGIVQAHDAAHAKVLLSRSSLSFNDTDHFVESLNFTVKNTGKKQIDLQISHVPAVTMFTLVENYIYPDEFPNDFAKEHASLKFSESKVTIDAGESIVIEVLATPPKGLNATRLPVWSGYVTINGTDGTSLSLPYQGLTGSLHDSMVLGPQDTWIANSTDENRFPLPDNTTWTLPKPGTANNLTDTLPGLTWFLALGSAKLHAEIMPVTTEKPTSSKKPRVIGEPIDFPLLWNAMGANSQAFTGELADGTFAPAGQYVVRYRALRIFGNEKKKEDWDEAYSPVFTIRYEK

SEQ ID NO: 89 - protein, 875 aa, Gibberella zeae
MVRFGLSALLFAGLSLAQDELSQPPQPEQGTVAHLPGAYIFEFEESQDTSVFYDKTESQSTTRVKFDYDLFKGVSVQFDDVASAEELAAKMAALPVVKNVWPVKVYGIPAPRVEWVAEPGMKAPLSKRAVNDTADTFSPHVMTQVDKLRKKGITGHGIKVAVIDTGIDYKHPALGGCFGPDCLVSFGTDLVGDDYDGFNAVHPDDDPMDCAGHGTHVAGIVAAQTNPFGFTGTAPGVTLGAYRVFGCSGEAGNDVLIAAYNQAYQDGADIITASIGGPSGWSEEPWAVAVSRIVEKGVPCPVSAGNSGDVGMFYASTAANGNKVMAIASYDNSDYISLLKQHHYTVDGSDTKIAFGMTAGTPAAWDDVKLPIWAPSLDTTVANGGCDPYPADTPDLSKFIVLVRRGTCTFAQKAQNAANAGAKYFIVYNNAGGANEIDVSAVKSILAAGMVTSKVGAKWIGLLKEGSKVTLEMSAGSDGEVIMEESKNDKTGGAVSTYSSWGPTWEMDVKPQFGSPGGNILSTYPLAKGGYAVLSGTSMACPLVAATIALIAEVRGTLDPETIENLLASTSNPQLFNDGTGFSDYLAPVPQQGGGMIQAYDAAYSTVLMDVSSLSFNDTDNFIKVRNFTIHNTGKKEIDLSVSHIPTKSVYTLDKDSIYASTFPNDVADAHAELKFSEAKLSVGAGEKVTIEVVPSAPEGLDAKRLALWSGYIAINGTGVSLSLPYQGMTGSLHDSVVLGSDDTWIARSNDKDKLTPVPANTTFILPVKGQNATDAQPAPALAWKLALGSAKLEAELIPVGGNSTKSLGAPAGFPVQWNPMGDGNIVWNGKLADGGYAPAGKYKVKYQALRIFGDEKVKSDWDHSESPVFSVKYP

SEQ ID NO: 90 - protein, 906 aa, Epichloe festucae
MVRLRTSFVASLLAAAASTLAADPNEKVANTVVPGAYIFELADGQDAAALEKAVGKDGKTRMRLDFDLFKAVSVQLHDVDKAKEKATKLAALPQVKSVYPVTLYKRPNPKIEWIAQKGSTMQKAALTSRADGPEGPDGPEGAHADTDTYSPHVMTQVDKLRAKGITGKRVKIALVDTGIDFGHPALGGCFGDGCLVSFGTDLVGDDFNGFNTPHPDNIPKDCSGHGTHVAGIIAAQNNTYGFTGTAPDATLGIYRVFGCTGESTNEILIAAFNMAYQGGANIITASVGSASGWSEDPWAEAVSRIVQKGVPCVLSAGNDGDQGIFYASAAADGHRVAAIAAFDNVQTPTVYSNSKYEIDDGPDKVFGYLASKPANWDGVTLPAWANSLDPTVVNDGCQPFPANTPDLSKYIVLIRRGGCNFDKKVGNAIAKGAKNVIVYNNAAAGAAVMDLNSLRPGSLNAASMIDADTGATFIKALKEGKKLTLKMSSPGKTGSTLRTFKNTATGGALSSTTSWGPTWEMDLKPQFGAVGGNILSTFPVALGSYAALSGTSMACPQVAGIMALIHQVRGTYDAELIQNLLSGNSNPQLFNDGTKFYDFLAPVPQQGAGLIQAYDAAYATTVLSPSGLSFNDTDHFAKRLEFKLKNTDKKRATYRVTHVPTITMYTLAKDSIYAQKFPNDHVDAAATLKFSKTSITLRGGEAETVTVSATPPEGLDTKRLALWSGYIVINGTDGASLSLPYQGLTGSLRDSTVLGPSDTWISKSIDEKARKVPPNSVFVIPGPGNAGVNDTLPVLSANLALGSIKVRADIVPLTPCRPNDMIPCPPKDMMTEFWGVKTIGQPYRFPAQWSSRGVNNWAWDGRLDSGNYAPPGKYQFVVRALRIFGDERKKEDWDVSTSPALIIEYQ

SEQ ID NO: 91 - protein, 881 aa, Nectria haematococca
MRLYSLVWLFAAAASAVDIKHIGIKKTSSRLPGAYIFEFEDDNDCSDFYAKASEHGTTRMQYDYKLFKGASIQFNDVDHAEDLAVMMTKMPAVKRSWPVKMISLPTPEVHWQGTPGKDYSAIRRRDLYGRDTTNDTFSPHIMTQVDKLRAEGATGKGIKVALVDSGVDYTHPALGGCFGPGCLVSFGTDLVGDTYNGKNAATPDDDPQDCQGHGTHTAGTLAAQANSMGFTGAAPGVTIGAYRAFGCKGESGNDILIAAFNRAFEDGADIISASIGGPAGWSEDPWAVAVSRIVDQGVPCILSAGNAGEAGLFYANTAGNGKHVTAVASFDNTKSLALFNVSHYTVNDGPKNEFGSLAGAPDAWKGVKLPLWALNYNTTVADDACSPLPANTPDLSKYIVLIRRGTCTFEVKATNLAKFGAQYMMIYSDLENLMPYDVSMVAGIKAAAIVSPSQGLEWMKHLSKGEKVVLEMSDGSDGNVMLQETVNNITAGAVSAFTSWGPTWEMDVKPQFGAPGGEILSTYPRDQGSFAVLSGTSMATPLLAGIVALIAEVRGTLDPIFLENLLSSTSKPQLFNDGKAFYRFLAPVPQQGSGIVQAHDAAHSKIILSPSSLSFNDTDHFVESLNFTLKNTGSEEVEFQISHVPAVTMYTLAKGYMYPDGFPNDFANEQASVRFSESKVSISPGDSIVIEVLPTPPQGVDAKRLPVWSGYVAINGTDGSALSLPYQGLTGSLHDSPVLGPNDTWITSSTDENFFPAKANKTWILPKAGTANNQTDELPAVVWFLALGTAKLHGDIIPVTTDKSSSSGKARVIGEPVNFPLLWNPMGRNSQPFTGELAGGGFAPAGMYVVRYRALRIFGNENDEKDWDESYSPPFAIQYAQ

SEQ ID NO: 92 - protein, 874 aa, Sordaria macrospora
MVRLGLATTLLAAASFAQAAHHKAPKVVPGAYIVEYEDSHAASILNSIKGDATIRKDIRHELFKGASFQFKDLDKAEDLAGKIAAMSGVKAMYPVRRYSVPEHTVHYTGSSVQEVVAKRDTAKDTFTPHLMTQVNKFRDSGITGKGIKVAVIDTGIDYLHPALGGCFGAGCLVSYGADLVGDDFNGSNTPVPDPDPMDCQGHGTHVSGIVASKTNNPYGIIGAASDVTLGAYRVFGCDGDVGNDILIEAYLKAYDDGSDIITASIGGASGWPEDSWAAVVSRIVEKGVPCLVSAGNSGDEGIFYASTAANGKRVTAVGSVDNIIAPALLSEGTYSVAGSSASAFGFTAGTPSAWANVSLPVWSVNFDTTDAANGCEAFPDNTPDLSKYITLIRRGSCTFVQKAQNAAAKGAKYIIFYNNAAGSTKVDISAVAGIQGSAMVTSETGAAWIKALQAGSEVIVNMADPETAPKNLSNFPNPNTAGFLSTYTSWGPTYEIDVKPQISAPGGMILSTYPRALGSYAVLSGTSMACPLAAATWALVMQKRGTKDPRVLENLFSATAHPNLFNDGTTTYPMLAPVAQQGAGLIQAWDAANANALLSISSISFNDTANIKPLQSFEVTNTGKKAVTYQLGHTSAATAYTFADANTIDPADFPNELVANKATLVITPAKLTLNPGQKKTVTVLAIPPKGLDAKRLPVYSGYITLNGTDSTGYSLPYQGVVGSMKAVTVLDKQYSYLSQSSDAALAPVAAGTVFTLPPAGKANETQYANTVYPTVVLTLAMGSAEVRADVVNAKGKTIGQVLTFPAYWNPRGTFEWNWDGALSDGSYAPAGTYKITLRALKIYGNSRKPQDWETQTTESFSIKYAKKNKREFTA

SEQ ID NO: 93 - protein, 886 aa, Glomerella graminicola
MVRSSLLLPLVAAASAVQAYVQSPKTVAGAFIVELEDGQDASEFLAKTKADAVTRMNLNFTLFKGASIQFNDLDTADAKAAQLAQLPSVKNMWPVRTYGIPDSEVVWTGTQGRDYVDVKKRQLGNDTFSTHVQTQVDKLHRNGVTGKGIKVAVIDTGIDYLHPALGGCFGPGCLVSYGTDLVGNNYDGFNEQVPDPDPMDCGGHGTHVAGIIAAQSNPFGFLGTAPGVTLGAYKVFGCEGQVGNDVLIAAYNRAFEEGSNIITASIGGPSGWTDEPWAATVSRIVDAGVPCTVSAGNSGDQGIFFASTAASGRHVTAIASFDNAVTPALLIENTFTVAGGAPSTFAYTPGEPSEWAGVELPLWAITTDSSSDAALGCDPYPAGTPDLSGKIVLVKRGVCTFVVKAQKAAAAGAKYIMVYNNVPGAGSVSVTAVPEILAIGMTTPDQGAAWLKSIAAGSEVVLKMTDPEKAEQILTQSVNTATGGYVSSYSSWGPNWDGQQKPQFGAVGGNVLSTYPRALGSYAVLSGTSMSCPQTAGIVALIAEVRKTLDPATIENLLSAHANPVNFNSGSGPEGLLAPVSQQGAGLVQAYDAAYSTILLSHSSLSFNDTDNFIPELNFTIKNTGSADVSFDLSNVGAATAYTFETAGDLTPALFPNNLTAEHATVAFSESKVSVPAGGEATILVTPTPPTLDAARLPVWSGYIAINGSDGSSMSLPYMGIGGSLHSHVTMDEALMTTSTSATAAEYAPVASNYTYVLPPPGTANKTDAVVPALAIDMVFGSALVRADLVPLTTYPPNITHKVFGTKTLGQPRSFPYTYTSRGVFAVNWDGQMDDGSYAPAGKYKFSVKSLRVFGDASKLEEYDVAETQPFRIIYGAANATAPARH

SEQ ID NO: 94 - protein, 876 aa, Neurospora tetrasperma
MVRLGLATTLLAAASFAQAAQQKAPAVVPGAYIVEYEDSHDPTSILASIKGDATIRKDIRHELFKGASFQFKDLNKADDLASKIAAMSGVKALYPVRRYSIPEHTVHSTGSAVQEVVAKRDTGNDTFSPHLMTQVNKFRDSGITGKGIKIAVIDTGIDYLHPALGGCFGPGCLVSYGTDLVGDDFNGSNTPVPDSDPMDTCNGHGSHVSGVISGNTNNPYGIIGAATDVTLGAYRVFGCSGDVGNDILIEAYLKAYDDGSDIITASIGGASGWPEDSWAAVVSRIVEKGVPCLVSAGNDGATGIFYASTAANGKRVTAVASVDNILAPALLSEASYSVANGSLSTFGFTAGSPSAWANVSLPVWSVNFNTADTANGCEAFPDDTPDLSKYIVLIRRGTCTFVQKAQNAAAKGAKYIIYYNNVSGSTKVDVSAVAGVKAAAMVTSETGVAWIKALQAGTQVTVNMADPETAPKNLNNFPNTATPGFLSTYTSWGPTYEVDVKPQISSPGGMILSTYPRALGSYAVLSGTSMACPLAAATWALVMQKRGTKDPKVLENLFSATAHPNLFNDGTKTYPMLAPVAQQGAGLIQAWDAANANALLSVSSISFNDTEHFKPLQSFEVTNTGKKAVTYQLGHTSAATAYTFANDNSIGPAAFPNELVDAKATLVLTPAKLTLNPGQKKTVTVLAIPPLGLDAKRLPVYSGYITLNGTDSTGYSLPYQGVVGSMRSVTVLDKQNSYLSQSSDATYAPVAAGTTFTLPPAGKANDTLYANTVYPTIVLTLSMGSAEVHADVVNSKGKTIGQVLTFPARWNPRGTFEWNWDGALSDGTYAPADTYKITLKALKIYGNSKWPLDWETQTTEPFTIKYAAKSKRAFTA

SEQ ID NO: 95 - protein, 876 aa, Neurospora crassa
MVRLGLATTLLAAASFAQAAHQKAPAVVPGAYIVEYEDSHDPTSILASIKGDATIRKDIRHELFKGASFQFKDLNKADDLASKVAAMSGVKALYPVRRYSIPEHTVHSTGSAVQEVVAKRDTGNDTFSPHLMTQVNKFRDSGITGKGIKIAVIDTGVDYLHPALGGCFGPGCLVSYGTDLVGDDFNGSNTPVPDSDPMDTCNGHGSHVLGLLSANTNNPYGIIGAAPDVTLGAYRVFGCSGDVGNDILIEAYLKAYDDGSDIITASIGGASGWPEDSWAAVVSRIVEKGVPCLVSAGNDGATGIFYASTAANGKRVTAVASVDNILAPALLSEASYSVANGSLSTFGFTAGSPSAWANVSLPVWSVNFNTADAANGCEAFPDDTPDLSKYIVLIRRGTCTFVQKAQNAAAKGAKYIIYYNNASGSTKVDVSAVADVKAAAMVTSETGAAWIKALQAGTQVTVNMADPETAPKNLNNFPNTATPGFLSTYTSWGPTYEVDVKPQISSPGGMILSTYPRALGSYAVLSGTSMACPLAAATWALVMQKRGTKDPKVLENLFSATAHPNLFNDGTKTYPMLAPVAQQGAGLIQAWDAANANALLSVSSISFNDTEHFKPLQSFEVTNTGKKAVTYQLGHTSAATAYTFANDTSIGPAAFPNELVDAKATLVLTPAKLTLNPGQKKTVTVLAIPPLGLDAKRLPVYSGYITLNGTDSTGYSLPYQGVVGSMRSVTVLDKQNSYLSQSSDATYAPVAAGTTFTLPPAGKANDTLYATTVYPTIVLTLSMGSAEVHADVVNSKGKTIGQVLTFPARWNPRGTFEWNWDGALSDGTYAPADTYKITLKALKIYGNSKWPLDWETQTTEPFTIKYAAKSKRAFTA

SEQ ID NO: 96 - protein, 902 aa, Magnaporthe oryzae
MVGKAIVLSLFAATCLASQATKPVEEKAPIIPGLYIVEYEEGQMDTATLSNEIASDAHVKMNLDFELFKGASIQFHDSAHVEETAAKIAEMPAIKRMWPQRLYRIPDYQVSWAGDMPDAQAKAVMRRQSDGNDTFTPHLMTQVNQLRNKGVVGKGIKVAVIDSGVDWKHPALGGCFGRPECLVSFGYDLVGDAYNGTNTAVPDNDPMDCGGHGTHVSGIIAAQTNNPFGIIGAATGVTMGHYRVFGCEGSASDDVLIQAYNMAYQDGADLITASIAGSSGWPEQAWAVAVTRIVDKGVPCVISAGNDGATGMFFTSSAADARGATAIASFDNSVTPQLLSNATYRVGGGQPVSFSYSAGSPAKWGNVTKQLWAVNFNTNDTQNACDPLPANTPDLSNFIVLIRRGTCPFTQKATNVRAKGAKYVFFYNNVPGTLSISVTAVDGILGAATVSAEIGKSWIAELAAGRNVTLEMTDPLTAPKFLLSAPNSATGGAPSTYTSWGPTFEGQVKPQVAAPGGNILSTYPLAKGGYAVLSGTSMACPLTAGVYALIMSVRGIKDPKTLENLVASTAKPTLFNSGSTSASYLAPVPQQGAGLIQAYDAAYTTTLLSVSSLAFNDTDNFAPVQNFTISNKGSSSVTYTLSQRGAATAFTFSSNASNITPEVFPNELVANYANLKFSEEKLEVGPGGNAQIAVTVTPPSGLDARRLPVYSGYVTINGTDGSSFSLPYMGIAGSIHAQRTLDPQQTFLSSNQIPRNFTEDNPPRVPAGHQFDLPPQGQANNTQYVLVSEMPRFSINLAWGTPLLRADVVALGGNSTAAEQPLAETEVLGLKTVGSLQYFPQRYQARTRSFVRWDGILDSGKYAPSGHYKIVFRALRVFGNSEKQDEYDVVETVPFKIRYINK

SEQ ID NO: 97 - protein, 1006 aa, Chaetomium globosum
MALFSAVEAWHPGLSPGATPSVDGDHPRGGAVRGALSQEGDISLQEHAPHESCYLIYYVQNASDHTVPPQAAPREEARPMYGQVKDELKHSKLSHDIRLQLFPLLWASFLSTSKGILLQRELRNGTCQAQPNSDHPSAGGSARPLCAPPSVDSNAFVNNLGGKASLRKDLRFKLFKGASIQFKDTKNADQMIAKVATMPKIKAVYPVRRYPVPRHVVHSTGDAVEAVLSKRQEGSDTFSTHLMTQVNRFKDKAVTGKGIKIGIIDTGTDYLHPALGGCFGEGCLVSYGTDLVGDKFNGANTPVPDADPLDECNGHGTHVAGIIAAQSNNPYGIVGAAEGVTLGSYRVFGCTGDVGNDILIAAYNMAYEDGSDIITASIGGASGWSEDPWAAVVSRIVDNGVPCVVSAGNDGAAGIFYASTAANGKRVTAIASVDNTVTPALLSNASFSINGTSDFFGFTAGEPGTWDDVTLPLWSVGFDTTDPANGCEPYPDSTPDLSGYIVLVRRGTCAFVDKAANAVAKGAKYVMFYNNVDGTVSVSANVEGVVGVAMVTPEQGEIWVRALEAGSEVVVHMTDPLKAGTFLSSSKNTLSGGFLSDFTSWGPTYEVEVKPQFSTPGGLILSTYPRALGSYGVLSGTSMACPMAAAIYALLMTARNTKDPKTLENVLSATARPNVFRLQGKSLPVLAPVAQQGAGLLQAWDAARATTLLSVSSISFNDTDNFSPVQNFSISNTGATAVTYSLSNIGAATAYTFNDEKTISPAAFPNELTGDFASLSFSPSNFTIPAGQRKIITVTATPPKGVNVKRLPVYSGYIAINGSDSSALSLPYLGVAGSMRSVVVLDSKAALISSARDQSNTPVPAGVTFVLPPPGFSNDSSYANRTERPKLVVSLAMGSAVLRADIVPVSNCTTVARTAGVVFGTKTIGQPEGLPALWNPRGRFEYSWDGKLDDGTYAPAGRYKFAVKALRIFGDREEVADYDAAETTDFRIRYLPAPSAKFRRQEQGCE

SEQ ID NO: 98 - protein, 541 aa, Trichoderma reesei
MRSVVALSMAAVAQASTFQIGTIHEKSAPVLSNVEANAIPDAYIIKFKDHVGEDDASKHHDWIQSIHTNVEQERLELRKRSNVFGADDVFDGLKHTFKIGDGFKGYAGHFHESVIEQVRNHPDVEYIERDSIVHTMLPLESKDSIIVEDSCNGETEKQAPWGLARISHRETLNFGSFNKYLYTADGGEGVDAYVIDTGTNIEHVDFEGRAKWGKTIPAGDEDEDGNGHGTHCSGTVAGKKYGVAKKAHVYAVKVLRSNGSGTMSDVVKGVEYAALSHIEQVKKAKKGKRKGFKGSVANMSLGGGKTQALDAAVNAAVRAGVHFAVAAGNDNADACNYSPAAATEPLTVGASALDDSRAYFSNYGKCTDIFAPGLSIQSTWIGSKYAVNTISGTSMASPHICGLLAYYLSLQPAGDSEFAVAPITPKKLKESVISVATKNALSDLPDSDTPNLLAWNGGGCSNFSQIVEAGSYTVKPKQNKQAKLPSTIEELEEAIEGDFEVVSGEIVKGAKSFGSKAEKFAKKIHDLVEEEIEEFISELSE

SEQ ID NO: 99 - protein, 537 aa, Trichoderma atroviride
MRSVIALSVAAVAQASSFQVGTIHESSAPVLSNIEANAIPDNYIIKFKDHVDEAGADKHQNWIQSIHDEGEQQRLELRKRSSIFGADEAFDGLKHTFKIGDFKGYAGHFTEDIIEQVRNHPDVEYIERDTIVHTMLPLDSQDSVVVEDSCNPETEKQAPWGLARISHRDTLGFGTFNKYLYTADGGEGVDAYVIDTGTNIEHVDFEGRAKWGKTIPAGDEDEDGNGHGTHCSGTVAGKKYGVAKKAHVYAVKVLRSNGSGTMSDVVKGVEYAALSHQEQVKQAKAGKRKGFKGSVANMSLGGGKTSALDAAVNAAVKAGVHFAVAAGNDNADACNYSPAAATEPVTVGASALDDSRAYFSNYGKCTDIFAPGLSIQSTWIGSKYAVNTISGTSMASPHIAGLLAYYLSLQPAGDSEFAVAPITPNKLKKDLITIATQGTLSDIPADTPNLLAWNGAGCSNYSQIVKAGGYKAKAQKQTKLPATIEELEDAIEGDFEVVSGKIVKGAKSFGSKAEKFAKKIHDLVEEEIDEFMSELSE

SEQ ID NO: 100 - protein, 1670 aa, Trichoderma virens
MRSVVALSVAAVAQASSFSIGTIHESSAPVLSTVEANAIPDAYIIKFKDHVGEADADKHHNWLQNIHSSGEQERLELRKRSNIFGSDDAFAGLKHTFKMDGFKGYAGHFHESVIEQVRNHPDVEYIERDSIVHTMLPLESKDTIIVEDSCNGETEKQAPWGLARISHRETLNFGSFNKYLYTAEGGEGVDAYVIDTGTNIDHVDFEGRAKWGKTIPAGDEDEDGNGHGTHCSGTVAGKKYGVAKKAHVYAVKVLRSNGSGTMSDVVKGVEWAALAHIEAVKQAKAGKRKGFKGSVANMSLGGGKTQALDAAVNAAVNAGVHFAVAAGNDNADACNYSPAAASAPLTVGASALDDSRAYFSNYGKCTDIFAPGLSIQSTWIGSKYAVNTISGTSMASPHICGLLAYYLSLQPAGDSEFAVAPITPKKLKENIVSIATKGALSDLPDSDTPNLLAWNGGGCSNFSQILEAGSYTVKPKAKHAKLPATVSELEKAIEGDFEVVSGKIVKGAKTFGSKAEKFAKKIHDLVEEEIEEFISELSDNGHNAPMRLSVRGFMDRYQERLVLFLGIRHALWARSHGFIFAFSYYSYLASPIWLRKTQMAASCQKPQSLTRKAGAKRCKTGSFRTIWQNGFFRYGRRHRRLLPLNWQEHAKRKTKISPSHYHSTRHRHLLHIVGQGVTIRATSLRSLYSLNNDNASQEQLQKPESSPPEQEQPYAAERDAYLAATLSYNRAQPQSNGGGKASRLHRQQSVRFAGPNAQPQRRLAARASMALVGNINMPRRPVGSQHLSQSSFEPGEDAASLSYARLRKSRSMYTPSIPNTPTYTMDSGDSVDVLNGWLPTPQIRKENEPLRSFGGPALRSPKSMGFLSNDCEISTSRASISSGHASVQQTRNGFYEPSERSSRLQSRPSSFFRSSYRHAPNPTSFPKSLRGSSNNTSFLSSESIYGAKFPPQIPSEQPGLRKKARKISKSLKSRIKGLFSRPKNRDDIVDQTEEHPQDLESNNGSSYSSQTPARLSHEASLYRVISHMPSFHAVPPSQQLRSRQGSLGTIEVEDNTLDDDKSRVTSWTNSTADTISNQLSANWSRQYPSLLQDDMDTTLSPHNQTSMYRKNMINTGPIVNSQRVYSALMKRLQEKNGHQNQSLGEDHMTPDPVETNSLRSTSTIRRQTRQAMYAGSTHTIRHVQYDDDVFQDSVEGSTTSRYSSESTKSVIRRHQSSDSLQDYGHKSCPSPGSGNVSGFPPNTNDVKPHPVTENQKPTLSGRSSAFFASPTCHLFRTTSPYRRALQESMRAAQASNQPQTPGTKHLSSLSALSLPIRRPSTEESDDDARVAYAESVYSNSSEENAPQVDEPSPPLRSTEEEPRPQVHGDATIFLNTERPRLPPPSHTRDSSSASSVEWKTWLSANVSKLETPPTTLKPDLSQEPSSAPQTFSHVREKTEIDSDVDDYPQDAPGGGLSPKLGLSKDNHSPSVLTPIPRGKFHLVNPWHLQSTASNENSPPTSGVRSKSACSKDASPVAPKGHLRTIPSVPNVNTCATNAESLMGEPRNPSLNTCSKPFDPVREEARLKRRSRTRLGANDASAKSSPGFTTALKRQFGVSRTGSPGVWKAEEPSGELGSEADPGVDELGRRDFDAQAMGSRRMVDLFLSSRRQRIAGSQTRQSSDSLSAAFI

SEQ ID NO: 101 - protein, 538 aa, Hypocrea lixii
MRTAVALSVAAVAQASTFQIGTIHENSAPVLSTVEANAIPDAYIIKFKDHVGEAQAEKHHDWLQSVHSSGEQERLELRKRSSIFGSDDVFDGLKHTFKMDGFKGYAGHFHESTIEQVRNHPDVEYIERDSIVHTMLPLESKDNIIIEDSCSPETEKQAPWGLARISHRDTLNFGSFNKYLYTAEGGEGVDAYIIDTGTNIEHVDFEGRAKWGKTIPAGDEDEDGNGHGTHCSGTVAGKKYGVAKKAHVYAVKVLRSNGSGTMSDVVKGVEFAAISHQEAVKQAKDGKRKGFKGSVANMSLGGGKTSALDAAVNAAVKAGIHFAVAAGNDNADACNYSPAAASEPVTVGASALDDSRAYFSNYGKCTDIFAPGLSIQSTWIGSKYAVNTISGTSMASPHIAGLLAYYLSLQPATDSEFAVAPITPNKLKKDIISVATVGTLSDIPSDTPNLLAWNGAGCSNYSQIIEAGSYTAKPKANKAKLPATIEELEEAIEGDFEVVSGKIVKGAKTFGSKAEKFAKKIHDLVEEEIEEFISELSE

SEQ ID NO: 102 - protein, 495 aa, Aspergillus fumigatus
MKGYLSLSILPLLVAASPVVVDSIHNGAAPILSSMNAKEVPDSYIVVFKKHVNAESAAAHHSWVQDIHSAQNERVELRKRSLFGFGEEAYLGLKNTFDIAGSLVGYSGHFHEDVIEQVRKHPDVEYIEKDSEVHTMEDPTVEKSAPWGLARISHRDSLSFGTFNKYLYASEGGEGVDAYTIDTGINVDHVDFEGRAQWGKTIPTDDEDADGNGHGTHCSGTIAGRKYGVAKKANLYAVKVLRSSGSGTMSDVVAGVEWAVKSHLKKVKDAKDGKIKGFKGSVANMSLGGGKSRTLEAAVNAGVEAGLHFAVAAGNDNADACNYSPAAAENPITVGASTLQDERAYFSNYGKCTDIFAPGLNILSTWIGSKHAVNTISGTSMASPHIAGLLAYFVSLQPSKDSAFAVDELTPKKLKKDIIAIATQGALTDIPSDTPNLLAWNGGGSSNYTDIIASGGYKVNASVKDRFEGLVHKAEKLLTEELGAIYSEIHDAAVA

SEQ ID NO: 103 - protein, 530 aa, Nectria haematococca
MRTALTLSLAAVANAASFSVGTIHDRSAPILSSIEAETIPDSYIIKFKDHVDETAASDHHTWIQNIHSHGEQERLELRKRSTPFTDKTFAGLKHTFNIGKGFKGYAGHFDESVIEQVRNHPDIEFIERDTLVHTMIPVQNQDAVSEYKCDDGKTETSAPWGLARISHRDTLNFGTFNKYLYSADGGEGVDAYIVDTGTNIDHVDFEGRAHWGKTVPAGDADEDGNGHGTHCSGTVAGKRYGVAKKANVYAVKVLRSNGSGSMSDVVKGVEFAATSHLEQAQKAKDGKRKGFKGSVANMSLGGGKTQALDAAVNAAVRTGVHFAVAAGNDNADACNYSPAAAAEPVTVGASALDDSRAYFSNYGKCTDIFAPGLNIQSTWIGSKYAINTISGTSMASPHIAGLLAYYLSLQPAEDSEYAMASITPKKLKENLISIATENALSDIPSDTPNLLAWNGGGCSDYKKIVEAGSYQVNKASPSSPAKQIKDAVEQEIGVVSGKVKEFGSKAEKFSKKIHNLVDEELEQFLKEINM

SEQ ID NO: 104 - protein, 533 aa, Gibberella zeae
MKSALTLSMAAVASAASFSVGTVHDKAAPILSSVDAETIPDSYIIKFKDHVDEHAASNHHMWVQDTHTQGESERMELRKRSIPFTDKTFSGLKHTFDIGEAFKGYAGHFDESMIEKVRNHPDVEFIERDTLVHTMVPITNNDMVTEDKCDGETERSAPWGLARISHRNTLNFGSFNKYLYSSDGGEGVDAYIVDTGTNIKHVDFEGRAHWGKTIPSGDADEDGNGHGTHCSGTVAGKKYGVAKKASVYAVKVLRSNGSGSMSDVVKGVEFAATSHLEQKKKAKDGKRKGFKGSVANMSLGGGKTQALDAAVNAAVRTGIHFAVAAGNDNADACNYSPAAASEPVTVGASAIDDSRAYFSNYGKCTDIFAPGLNIVSTWIGTDKAINTISGTSMASPHIAGLLAYYLSLQPAEDSEYALASITPKKLKENLISVATENALSDIPSDTPNLLAWNGGGCSDYKKIVEAGSYKVNKAAPSSRVEDIKHAVEQEVEVVSGKLTTGAKQLGSKAEKFSKKIHELVDEELEQFIKELNL

SEQ ID NO: 105 - protein, 532 aa, Isaria farinosa
MKSFVAALSVAAIAQASSFKIGTIHHDSAPILDATHANTIPGAYIIKFKEHVDEPKAKTHHAWVTDIHGDGQQQRIELRKRGLFDSVEDVFDGVKHTFDLGAGFRGYAGHFDDAVIEQIRNHPDVEAIERDSIVHTMVPVSAKDTVTEDTCNPETEKQAPWGLARISHRKTLGFGTFNKYLYAEDGGEGVDAYVIDTGTNIAHVDFEGRAKWGYTAPDGDADEDGNGHGTHCSGTIAGKKYGVAKKANVYAVKVLRSNGSGTMSDVIKGVDWAAKSHEQQVKDAKAGKRKGFKGSVANMSLGGGKTTLLDIAVDAAVAKGLHFAVAAGNDNADACNYSPAAAKNAVTVGASTIDDSRAYFSNYGKCTDIFAPGLNIQSTWIGSKYAINTISGTSMASPHICGLLAYYLSLQPASDSEYAVASITPAELKDNLITIGTKNTLSDIDSDTPNVLAWNGAGCSDYKKIVEAGAYDAKRTSSKSENIHTKIQHEFEIVSGEITKSAKTFGSKAEKFAKKIQHIVDAEVEDFLSHME

SEQ ID NO: 106 - protein, 537 aa, Glomerella graminicola
MRGFIGAVAGLAAVASATPSLSIETIHDGAAPVISSTNAEAVPNSYIIKFKKHVSDTDAEDHHNWVQQIHSSSQDERLELRKRGQEPLVDNVFHGLKHTYKIGNDFLGYAGHFDEATIEKIRRHSDVEFIEVDSVVHTQVPVKSQGAEAEDTCDGELEKLAPWGLARVSHRKSLGFGTYDKYLYAEDAGEGVDAYVIDTGTNVDHVDFEGRAKWGKTIPSGDQDVDGNGHGTHCSGTIAGKKYGVAKKANVYAVKVLRSNGSGTMSDVVKGVEWAATSHIEQVKAAKDGKRKGFKGSVANMSLGGGKTQALDAVVNAAVDAGIHFAVAAGNDNADACNYSPAAAEKAVTVGATELGDRRSYFSNYGKCTDIFAPGTNIKSTWIGSKYAVNTISGTSMASPHICGLLAYYLSLQPSTDSEYSVAPITPQKLKKALISVGTVGALADIPRDTPNVLAWNGGGCSNYSAIIEAGSYTVKQETKEATIDDLEKAIEEDFEVLSGKVVKGAKNIGTKAEKLAKKIHNLVDEELKEFLRETSL

SEQ ID NO: 107 - protein, 531 aa, Epichloe festucae
MKTILALSVAAVAQAAFSTETIHKGSAPVLSSIHADVVPDSYIIKFKDHVDEAKANEHHAWVKDIHTGGEEDRFELRKRGLGSSIVDAFSGTKHTFNFDGFKGYSGHFHESVIEKVRNNPDVEFIEKDTVVHTMLPLTSEHSVQEDKCDPGETEKQAPWGLARLSHRDSLRFSTYNKYLYATEGGEGVDAYVIDTGTNVDHVDFEGRAKWGKTIPSGDADEDGNGHGTHCSGTIAGKKYGVAKKAHVYAVKVLRSNGSGSMSDVVKGVEFAANSHTEQVKAAKDGKRKGFKGSVANMSLGGGKTSALDAAVNAAVKVGIHFAVAAGNDNADACDYSPAAAEHPVTVGASAFDDSRAYFSNYGKCTDIFAPGLNILSTWIGSKYAVNTISGTSMASPHICGLLAYYLSLQPAKDSEYSVAAMTPKDLKDALIEVSTEGVLSDIPSDTPNKLAWNGGGCNNYSKIVAAGGYKAKSEASELKKIEKVAMDEAKEISGKVVKGVKHLGEKTEKFVEKVHSVVDKEIEHFISEISS

SEQ ID NO: 108 - protein, 533 aa, Metarhizium acridum
MHTLVAAVALSVVGVAQAGFSIETIHKESAPILSSVDAEVVPDSYIIKFKDHVNEAAANDHRSWIQSIHKDGEEERLELRKRSLGSSPVEAFAGLKHTYNIANGFKGYSGHFHESVIEKVRNHRDVEFVEKDTIARILRPVISDESAQEDCTPETERQAPWGLARVSHRKGLSFGTYNKYLYAADGGEGVDAYVIDTGTNTEHVDFEGRAKWGKTIPAGDADEDGNGHGTHCSGTIAGKKYGVAKKANVYAVKVLRSNGSGTMADVVKGVEFAATNHVEQVLLAKDGKRKGFKGSVANMSLGGGKTQALDAAVNAAVKAGIHFAVAAGNDNADACNYSPAAAELPVTVGASAFDDSRAYFSNYGKCTDIFAPGLNILSTWIGSKTAVNTISGTSMASPHICGLLAYYLSLQPAGDSEFSVAPITPKQLKDTLIEISTQGVLTDIPKDTPNKLAWNGGGCSNYSKIVAAGGWTGKSKTSETKPVENAVKEEMKVLSNKVSEGVKDLGDKTEKFVAKIHDVVDKEIEHFISEISL

SEQ ID NO: 109 - protein, 535 aa, Acremonium sp.
MRAVIALSFAAYASAAPRVSFETIHGDAAPILSASNAEIIPNSYIIKFKKHVTDDSASAHHSWIQEIHTSRESERADLKKRGQIPLVDDVFRGLKHTYKIGQEFLGYSGHFDDEVIEQVRRHPDVEYIERDSIVHTMRVAENAQCDSELEKAAPWGLARISHRNTLSFATFNKYLFAAEGGEGVDAYVIDTGTNIEHVDFEGRAKWGKTIPSGDADVDGNGHGTHCSGTIAGKKYGVAKKANVYAVKVLRSNGSGTMADVVAGVEWAAKAHLEQVKAAKDGKRKGFKGSVANMSLGGGKTKALDDTVNAAVSVGIHFAVAAGNDNADACNYSPAAAEKAVTVGASAIDDSRAYFSNYGKCTDIFAPGLSILSTWIGSKYATNTISGTSMASPHICGLLAYYLSLQPASDSEYSVAPITPEKLKSNLLQIATQDALTDMPKGTPNLLAWNGGGCNNYTAIVEAGGYKVERQSKTDKIDIGKSVSELEKLIEHDFEVVSGKVVKGVSSFAGKAEEFSKKIHQLVDEELKDFLEDIAA

SEQ ID NO: 110 - protein, 503 aa, Ophiostoma piliferum
MSLASVAVAAPSFTTGTVHGDAAPILASVNTEAIPNSYIVKFKNHVNEKDVSTHHSWVQSLHDQGEEKRLELRRRGMDFGILSGVKHTFKIGETFKGYAGQFDDELIEQLRRHPDVEYIEKDTVVHTMQPVSSEETCSSEVEKNSPWGLARISHRDTLSFGTFNKYLYSSEGGEGVDVYVIDTGCNVDHVDFEGRATWGKTIPSGVSDLDGNGHGTHCSGTIAGKKYGVAKKARVYAVKVLRSNGSGTMSDVVKGVEWAANAHLEALKQAKAGKRKGFKGSAANMSLGGGKTVALEEVVNAAVEAGVHFAVAAGNDNADACNYSPAAAQNAVTVGASALDDSRAYFSNWGKCTDIFAPGLSIQSTWIGSKHAVNTISGTSMASPHIAGLLAYYLSLQPAADSEYAVAAITPAELKANIISIATEGALSDLPKDTPNVLAWNGGGCSNYSSILEQGSYKVKSSKNSKLDIEALEKAIENDLNIVSGQIVKGAESLASKAQKFST

SEQ ID NO: 111 - protein, 532 aa, Neurospora tetrasperma
MRGLLALSLAACAAAAPAVSHESIHGDAAPILSSSNAEVVPNSYIIKFKKHVTDDKISDHHTWIQKIHSSRMDLKKRSQIPMVDDVFRGLKHTYKIGQDFMGYSGHFDEDTIEAVRRHPDVEYIERDSIVHTMSVSEDVDSEGKCDSDIEKSAPWGLARISHRDTLSFATFNKYLYAAEGGEGVDAYVIDTGTNVEHVDFEGRAKWGKTIPNGDADVDGNGHGTHCSGTIAGKKYGVAKKASVYAVKVLRSNGSGTMADVVAGVEWAAKSHLEQVKAAKDGKRKGFKGSVANMSLGGGKTQALDDTVNAAVSVGIHFAVAAGNDNADACNYSPAAAAKAVTVGASAIDDSRAYFSNYGKCTDIFAPGLSILSTWIGSKYATNTISGTSMASPHICGLLAYYLSLQPSSDSEYSLATISPEKMKANLLKIATVGALSDMPRDTPNLLAWNGGGCSNYSAIVDAGSYKATPKAQSDKISSVSELEKAIEHDYEVISGKVVKGVSSLSDKAEKLSEKIHDMVEEELKEFLEEIAH

SEQ ID NO: 112 - protein, 532 aa, Chaetomium thermophilum
MRGLFFLSLAAYAAAAPRAKVGTIDNDAAPILSSSNAEIVPNAYIIKFKKHVTPEVAAAHHTWIQEIHSAAETRRLDLKKRSQFPFVDQVFHGLKHTYQIGQEFLGYAGHFDDETIEQVRRHPDVEYIERDTIVHTMRFEEAKEECHGEIEKSAPWGLARISHRDTLTFSTFNKYLYAAEGGEGVDAYVIDTGTNIEHVDFEGRAKWGKTIPAGDADVDGNGHGTHCSGTIAGKKYGVAKKANIYAVKVLRSNGSGTMSDVVAGVEWVATQHLENVKLAKAGKRKGFKGSVANMSLGGGKTRTLDDTVNAAVAVGVHFAVAAGNDNADACNYSPAAAESAITVGASAIDDSRAYFSNYGKCTDIFAPGLSILSTWIGSKYATNTISGTSMASPHIAGLLAYYLSLQPSEDSEYSVAPITPKKMKENLLKIATEGALSDLPRDTPNLLAWNGGGCSNYSAIIEAGGYKVERKSQSSKIEIPTSFSDVEEELKSISKKVHEGASSFADRAKKFTEKIHKLVDEELKEFIEELGA

SEQ ID NO: 113 - protein, 510 aa, Metarhizium flavoviride
PFVAAVALSVVGVAQAGFSIETIHKESAPILTHVDAEVVPDSYIIKFKDHVNEAAVNDHHSWIQSIHKDGEEERLELRKRSLGSSPVEAFAGLKHTYNIASGFKGYSGHFHESIIEKVRNHGDVEFIEKDTIARILRPVTPDESVQEDCTPETEKQAPWGLARVSHRKGLSFGTYNKYLYAADGGEGVDAYVIDTGTNTDHVDFEGRAKWGKTIPAGDADEDGNGHGTHCSGTIAGKKYGVAKKANVYAVKVLRSNGSGTMADVVKGVEFAATRHVEQVLRAKDGRRKGFKGSVANMSLGGGKTQALDAAVNAAVKAGIHFAVAAGNDNADACNYSPAAAELPVTVGASAFDDSRAYFSNYGKCTDIFAPGLNILSTWIGSPTAVNTISGTSMASPHICGLLAYYLSLQPAGDSEFSVASITPKQLKETLIDISTQGVLTDIPNDTPNKLAWNGGGCSNYSKIVAAGGYIGVPRTSEPKPVGNAVKEEMKVLSHKVSQGVKDLGDKTEKG

SEQ ID NO: 114 - protein, 531 aa, Podospora anserina
MKGYAILSLAAAAAAAPSASIETIHGEAAPILSSANAEVIPNAYIVKFKKHVTEEKVSDHHTWIQELHTTRENERIDLKKRGQFPLVDDVFHGLKHTYKVGSEFLGYAGHFDEETIEKVRRHPDVEYIERDSIVHTMRVIEDAKCDSEIEKAAPWGLARISHRDTLGFSTFNKYLYAAEGGEGVDAYVIDTGTNVDHVDFDGRAKWGKTIPSGDADVDGNGHGTHCSGTIAGKKYGVAKKANVYAVKVLRSNGSGTMSDVVAGVEWAAKSHIQAVKEAKDGKRKGFKGSVANMSLGGGKTKTLDDTVNAAVSVGIHFAVAAGNDNADACNYSPAAAAKAVTVGASGIDDSRAYFSNYGKCTDIFAPGLSILSTWIGSKYATNTISGTSMASPHIAGLLAYYLSLQPATDSEYSLAPITPEKLKDNLLKIATEDALTDMPKGTPNLLAWNGAGCNNYTAIVEAGGYKVKKTEGTKADFDVSKLEELIENEYDVISGQVVKGVSSLSEKARKFSKKIHEMVDEELKEFLEELA

SEQ ID NO: 115 - protein, 536 aa, Magnaporthe oryzae
MKSVILLSLAACAVAAPTAGVETIHDGAAPILSSSNAEAIPNAYIIKFKKHVDHKSAADHQMWIQKVHGEREDERLELRKRGLFDSVNDAFTGLKHTYNVGSGFLGYAGHFDEETIEKVRRHPDVEAIERDTIVHTMRYEEVKKDECNPDLEKGAPWGLSRVSHRESLSFSTYNKYLYSAEGGEGVDAYVIDTGTNIDHVDFEGRAHWGKTIPANDQDIDGNGHGTHCSGTVAGKKYGVAKKAQVYAVKVLKSNGSGTMSDVIAGVDFAAKSHKAQVSAAKDGKRKGFKGSVANMSLGGGKTTLLDAAVNAAVDAGIHFAVAAGNDNADACNYSPAAAAKAVTVGASALDDSRAYFSNWGKCTDIFAPGLNIQSTWIGSKTAINTISGTSMASPHIAGLLAYYLSLQPASDSEYSLATITPEKLKADLIKVGTVGILTDIPKDTPNVLAWNGGGCSNYFEIVSKGGYKAKAQADKSSSLLDSVTELEKAIEHDFRVISGKVVKEASSMTGQAEKLSEKIHQAVDEELKHFFGEARV

SEQ ID NO: 116 - protein, 522 aa, Sclerotinia sclerotiorum
MRGLVSLSLLPLLASSAPTFSTETIHEGVAPLLSSSNSVAVPDSYIVVFKKHVTEASATEHHSWVQDIHSNGEAQRTELRKRGQFPITTDIFEGLKHTYNIAGDFLGYSGHFDDSVIEEVRRHPDVEYVEKDSIVHTLGDSEGEIEKNAPWGLARISHRDSLSFGTFNKYLYAADAGEGVDAYVIDTGTNTEHVDFEGRAHWGKTIPAGDADEDGNGHGTHCSGTVAGKKYGVAKKANVYAVKVLRSNGSGTMADVVKGVEWAANSHTKKVKEGKKGFKGSVANMSLGGGKSPALDRAVNGAVAAGIHFAVAAGNDNADSCNYSPAAAENAITVGASAVDDSRAYFSNYGTCNDIFAPGLSILSTWIGSKYAVNTISGTSMASPHICGLLAYYLSLQPSSDSAYAVAEITPKKMKENLLSVATEGALSDVPSNTKNILAWNGGGSSNYTSIIKAGGYAAKASKKVPTTVELLEKAIENDFNMLSGKVVKGGESIVSKTEELSKKIQKIVDEEISEFFEEFSS

SEQ ID NO: 117 - protein, 491 aa, Talaromyces stipitatus
MKGILGLSLLPLLTVASPVMPSTIHNDAAPILSSSNAVEVPDSYIIVFKNHVDPASAAAHHSWVQDIHNQHTELRKRSQFPFAGDVFAGLKHTFDIAGSFLGYSGHFDENVIEAIRRHPDVDYIEKDSIVHTMEDPTTEKNAPWGLARISHRESLSFGSFNKYLYAADGGEGVDVYVIDTGTNIDHVDFEGRASWGKTIPTDDEDVDGNGHGTHCSGTIAGKKYGVAKKANVYAVKVLKSNGSGTMSDVVQGVEWAATQHIKKVKDAKAGKAKGFKGSAANMSLGGGKSVTLDRAVNAAVDAGIHFAVAAGNDNADSCNYSPAAAEKAVTVGASTLADERAYFSNYGKCNDIFAPGLNILSTWIGSKYAVNTISGTSMASPHIAGLLAYFLSLQPASDSAFAVAEITPKKLKENLITIGTQGVLTDVPSDTTNILAWNGGGSSNYSDIIAKGGYKTKSVSDQVDDLIIKAQEVVNEELGAIYSHIKDAVVA

SEQ ID NO: 118 - protein, 256 aa, Trichoderma reesei
MFIAGVALSALLCADTVLAGVAQDRGLAARLARRAGRRSAPFRNDTSHATVQSNWGGAILEGSGFTAASATVNVPRGGGGSNAAGSAWVGIDGASCQTAILQTGFDWYGDGTYDAWYEWYPEFAADFSGIDIRQGDQIAMSVVATSLTGGSATLENLSTGQKVTQNFNRVTAGSLCETSAEFIIEDFEECNSNGSNCQPVPFASFSPAITFSSATATRSGRSVSLSGAEITEVIVNNQDLTRCSVSGSSTLTCSYV

SEQ ID NO: 119 - protein, 256 aa, Trichoderma atroviride
MKFITGIAISALLCADAALAGVAANRGLARRLARRAGRRSAPFKNNTLHASVQSNWGGAILQGSGYSAASATVNVPTGGGGSSAAGTAWVGIDGDTCDSAILQTGIDWYGDGTYDAWYEWYPEFSADFSGIDISAGDQIAMSVVATSLTGGSATLENLTSGQKVTQNFSKVTAGSLCETSAEFIIEDFEECNENGSDCQFVPFASFSPAVKFSSASATQNGRTVSLSGAVLTEVEINNKDVTKCSVSGSTLTCSYV

SEQ ID NO: 120 - protein, 256 aa, Trichoderma virens
MMFVAGVALTALLCADAALAGVAQNRGLAARLARRAGRRSAPMRNNTSHATVQSNWGGAILEGSGFTAASATVNVPKGGGGSSAAGSAWVGIDGATCDSAILQTGFDWYGDGTYDAWYEWYPEFAADFTGIDINQGDQIAMSVVATSLTGGSATLQNLSTGQKVTQTFSRVTAGSLCETSAEFIIEDFEECNSNGSNCQPVPFASFSPAIQFTSASATRSGQKVSLSGAVMSEVIVNNKDLTKCSVSGSTLTCSYV

SEQ ID NO: 121 - protein, 271 aa, Aspergillus flavus
MKLFAILSSTVLASVALASPLTLERRARNAARLQARVAQRHSNLPFKAGTNEILHLNETTHEEYSSNWAGAVLIGSGYTSVTGTFTVPTPSAPSGADSDEQYCATAWVGIDGDTCQSAILQTGVDFCIDSSGTTFDAWYEWFPDYSHDFSGISISAGDKVKVTVDASSKTAGTAIVENLTTGKTVSHTFTGQDDNALCETNAEWIMEDFSSFLSLVPFANFGTVTFTDISATSGDSSVGASNATIIDIQQNNKTLTSSSASDTEVTIKYIG

SEQ ID NO: 122 - protein, 265 aa, Aspergillus niger
MKTTALLTAGLLATTAMAAPLTAKRQAARAKRSTNRQSNPPFKPGTNEVLALNGTKNVEYSSNWAGAVLIGTGYTAVTAEFVVPTPSVPSGGSSREEYCASAWVGIDGDTCDTAILQTGVDFCVQGSEVSFDAWYEWYPDYAYDFSGISISAGDTIKVTVDASSDTTGTATIENVSTGTTVTHSFTGGVDGDLCEYNAEWIVEDFEEDDSLVPFADFGTVTFTSCSATKDGSSVGPEDATIIDIEQNEVLTSVSVSSSEVVVKYV

SEQ ID NO: 123 - protein, 268 aa, Aspergillus terreus
MKLSVLSSILLAGTAVAAPLTAQRQARNARRVARAANRSSHPPYKPDSSELLHLSNTTHVEYSSNWAGAVLIGTGYTAVTGEFTVPTPSTPSGSSSSKEYCASAWVGIDGDTCSTAILQTGVDFCVQGSSVSFDAWYEWYPDYAYDFSGITISAGDTIRVTVDATSKTAGTATVENLTTGKTVTHTFTGGVDGSLCEYNAEWIVEDFEENGSLVPFADFGTVTFSSAEATDGGSTVGPSGATVIDIEQSNKVLTSVSVGSSSVTVKYV

SEQ ID NO: 124 - protein, 260 aa, Scytalidium lignicola
MKFTTAAVLSALVSAEIAFAAPGGNGFARRQARRQARAAGLKASPFRQVNAKEATVESNWGGAILIGSDFDTVSATANVPSASGGSSAAGTAWVGIDGDTCQTAILQTGFDWYGDGTYDAWYEWYPEVSDDFSGITISEGDSIQMSVTATSDTSGSATLENLTTGQKVSKSFSNESSGSLCRTNAEFIIEDFEECNSNGSDCEFVPFASFSPAVEFTDCSVTSDGESVSLDDAQITQVIINNQDVTDCSVSGTTVSCSYV

SEQ ID NO: 125 - protein, 206 aa, Scytalidium lignicola
TVESNWGGAILIGSDFDTVSATANVPSASGGSSAAGTAWVGIDGDTCQTAILQTGFDWYGDGTYDAWYEWYPEVSDDFSGITISEGDSIQMSVTATSDTSGSATLENLTTGQKVSKSFSNESSGSLCRTNAEFIIEDFEECNSNGSDCEFVPFASFSPAVEFTDCSVTSDGESVSLDDAQITQVIINNQDVTDCSVSGTTVSCSYV

SEQ ID NO: 126 - protein, 204 aa, Scytalidium lignicola
TVESNWGGAILIGSDFDTVSATANVPSATGASGGSSAAWVGIDGDTCQTAILQTGFDWYGDGTYDAWYEWYPEVSDDFSGITISEGDSIQMSVTATSDTSGSATLENLTTGQKVSKSFSNESSGLCRTNAEFIIEDFEECNSDGSDEFVPFASFSPAVEFTDCSVTSDGESVSLDDAQITQVIINNQDVTDCSVSGTTVSCSYV

SEQ ID NO: 127 - protein, 245 aa, Thielavia terrestris
MKNAILIAAAVGLAAALPQPGAPLTRRGGTRPPHHSAPRRNTTYPEYSSNWAGAVQIGTGFTFVTGTITVPSVYNGNPYSAASAWVGIDGDTCQTAILQTGVSFYGDGSYDAWYEWIPDYSYSFSGFGLRAGDEIRMTVDATSKTTGVATLENLSTGAKVSHTFRNTPSTLCETNAEWIVEDFESGGSLVPFADFGTVTFTDAYATGSGGQVTPQGATIIDIRQSGRVLTNCGTSGADLTCTYTG

SEQ ID NO: 128 - protein, 270 aa, Penicillium chrysogenum
MKFSTTILSAALLTASAIAAPLTERRAARHAARAADRAGRISRPAAKQDTLELVSLNGTSHAQYSSNWAGAVLIGTGYTSVTGEFTVPKPNLPSDASSGQQSCASAWVGIDGDTCSSAILQTGIDFCIQGGEVSYDAWYEWYPDYAHDFSGIDISTGDVIKLTVTATSKSSGSAVIDNVTTGKSVTHKFSGVDDGDLCETNAEWIVEDFESGGQLVPFTNFGTVTFTKAEATSGGKSVGPSGATLFEIRQSKKVLTKSSVTGNSVTVSYV

SEQ ID NO: 129 - protein, 236 aa, Trichoderma reesei
MDAIRARSAARRSNRFQAGSSKNVNGTADVESTNWAGAAITTSGVTEVSGTFTVPRPSVPAGGSSREEYCGAAWVGIDGYSDADLIQTGVLWCVEDGEYLYEAWYEYLPAALVEYSGISVTAGSVVTVTATKTGTNSGVTTLTSGGKTVSHTFSRQNSPLPGTSAEWIVEDFTSGSSLVPFADFGSVTFTGATAVVNGATVTAGGDSPVIIDLEDSRGDILTSTTVSGSTVTVEYE

SEQ ID NO: 130 - protein, 265 aa, Trichoderma atroviride
MKSLTLAANLLLVASAAMATPLAARKQAAMDALRARNAARRSNKFQASSSTHVNSTADVESTNWAGAALTTSGITEVTGTFTVPKPTVPSGGSSSTEYCGAAWVGIDGYSDADLIQTGVLWCVQSGEYLYEAWYEYLPASLIAYSGITVTAGSVVTVTATKTGNNSGTTTLTSGGKTVSHTFSNQNSPLPGTSAEWIVEDFTSGSSLVPFADFGSVTFTGSSALVNGQTVTPGSGSSTIIDLENSRGQIITSTSISGGSVTVNYE

SEQ ID NO: 131 - protein, 237 aa, Trichoderma virens
MDAIRARNAVRRSNRFLAGSNSNNVNGTADVESHNWAGAALTTSGVTEVSGTFTVPKPSIPAGGSSRTEYCGAAWVGIDGYSNADLIQTGVLWCVEGGQFLYEAWYEYLPASLVAYSGISVTAGSVVTVTATKTGTNSGVTTLTSGGKTVSHTFSRESSSLPGTSAEWIVEDFTSGSSLVPFANFGSVTFTGASAVVNGATVTPGSGSAVIIDLEDASGDIITSTSVSGSSLTVNYE

SEQ ID NO: 132 - protein, 259 aa, Bombyx mori
MKFTSLTANLLLVATTALASPLSARKQAAMDALRARRSFRRSNNTAGTADATSPNWAGVAISQTGVTEVSGTFTVPQPKLPAGGDPSVSYCGVAWVGIDGWTNGDLIQTGVLWCITEGETFWDPWYEYLPGAITIYEGVTVSAGSVVTVTATKTGTNSGVTTLTVDGITVSHTFTGENFSLPGTSAEWIVEDYEYSVAGPPFVPFADFGSVTFTGATAVVNGATITPGEGNWVIIDLERSNSSITSSSFSGSTVTINYL

SEQ ID NO: 133 - protein, 271 aa, Aspergillus flavus; identical to SEQ ID NO: 121

SEQ ID NO: 134 - protein, 265 aa, Aspergillus niger; identical to SEQ ID NO: 122

SEQ ID NO: 135 - protein, 270 aa, Aspergillus nidulans
MKLSIAAISSILLAGGALAAPLTEARRQARALRGRGPSNRASHPPYKVGSTELLSLSNETQVEYSSNWAGAVLIGTGYTSVTGEFTVPTPSLPTGASRNKQYCASAWVGIDGDTCSTAILQTGIDFCIQGSSVSFDAWYEWYPDYAYDFSGITISAGDSIRVTVDATTLTAGTATVENLTTGKTVTHTFTGGVDGDLCEYNAEWIVEDFESNGQLVPFADFGTVTFTSAEVTNDGKTVGPSGATIIDIKQGNSVLTDVSVTDDSVTVSYV

SEQ ID NO: 136 - protein, 269 aa, Aspergillus clavatus
MKFSAVVASSLLAGAAIAAPLTEQRQARHARRTARATNRSSHPPYKVGSSELLELSNSTHVEYSSNWAGAVLIGNGYTSVVGEFTVPEPSAPDGADSGTQYCASAWVGIDGDTCSSAILQTGVDFCIQDGSVSFDAWYEWYPDYAYDFSGIDISVGDTIKLTIDATSKTAGSAIIQNLSTGKTVKHTFTGGVDGDLCETNAEWIVEDFESNGSLVPFVNFGTVTFTGAKATTGGSSVGPSGATLMDIKQGSSVLTSSSVSGNSVSVSYV

SEQ ID NO: 137 - protein, 269 aa, Aspergillus fumigatus
MKFTSVLASGLLATAAIAAPLTEQRQARHARRLARTANRSSHPPYKPGTSEVIKLSNTTQVEYSSNWAGAVLIGTGYTAVTGEFVVPTPSVPSGGSSSKQYCASAWVGIDGDTCSSAILQTGVDFCIQGSSVSFDAWYEWYPDYAYDFSGISISAGDTIRVTVDATSKTAGTATVENVTKGKTVTHTFTGGVDGNLCEYNAEWIVEDFESNGSLVPFANFGTVTFTGAQATDGGSTVGPSGATLIDIQQSGKVLTSVSTSSSSVTVKYV

SEQ ID NO: 138 - protein, 262 aa, Penicillium marneffei
MKSSVLSTLLLAGLAVAAPSTQKGLARRAARRSNPAYLPNSFGVEQLNITGTKHVEYSSNWSGAVLIGTGYSAVTAEFTVPTPHIPSGGSSGTQYCASAWVGLDGDTCGTSILQTGVDFCVQGSSVSYDAWYEWYPDYAYDFTGISISAGDLIKITVTATSTSSGSAVVQNVSKGTTVTHNFSGESDKLCEYNAEWIVEDFEEGGSLVPFANFGTVTFSGAKATKSGSSVDTTGATIIDIEQNSSVLTSVTASGSTVTVKYV

SEQ ID NO: 139 - protein, 274 aa, Talaromyces stipitatus
MKSIVLSLLILAGLTAAAPLTEKRLARRAAGTRRSSPPYVPNSYGVEQLNITNSKNVEYSENWAGAVLIGTGYTAVTAEFTVPTPTAPGGGNTEYCASAWVGLDGDTCDSSILQTGVDFCVQGGDVSYDAWYEWYPDYAYDFSGISISAGDVMKITVTATSTSSGSAVVENVSTGRTVTHSFSGESDRLCEYNAEWIVEDFEEGDSLVPFANFGTVTFTNAVATHNGAGVGTSGATIIDIEQDSGVLTSVSASGNTVTVNMKHTNTDIHDDGGG

SEQ ID NO: 140 - protein, 274 aa, Grosmannia clavigera
MKLLNVAGALLFANAALGARFTERRRARLAQRAPGSVSRTGFGQPLIAADGLDIDEDAATNGTADVDYSSNWSGAVLISTGYKSVTGTFVVPTPKAPTGGSSSTQYAASAWVGIDGDTASNSILQTGIDFYIEDGEASYDAWYEWYPDYAYTFSGFSISAGDTITVTVTASSTSSGKAVIKNASTGKSVTHSFSSESNTLEELNAEWIVEDFEEDGGLVPFANFGTVTFTDATAIGSDGTVGPDGATLIDIRQSGKVLTSASLSGGDVVVSYVG

SEQ ID NO: 141 - protein, 269 aa, Neosartorya fischeri
MKFTSVLTSGLLATATIAAPLTEQRQARHARRMARNSNRSSHPPYKPGTSEVIKLSNTTQVEYSSNWAGAVLIGSGYTAVTGEFVVPTPHAPSGGSSNEQYCASAWVGIDGDTCSSAILQTGVDFCIQGGSVSFDAWYEWYPDYAYDFSGISISAGDTIRVTVDATSKTAGTATVENVTKGKTVTHTFTGGVDGNLCEYNAEWIVEDFESNGSLVPFANFGTVTFTGAQATDGGSTVGPSGATLMDIEQNGQVLTSVSSSSSSVTVKYV

SEQ ID NO: 142 - protein, 270 aa, Penicillium marneffei
MIFSIKTLVPLLLAGTAIASPATIPAARRFRGGSDASFANFTSSADEASAATLGTYTFTNWAGAFLRNTAVTSVTGTFVIPKPSMPAGGNSGTSYCGCAWVGLDGISNFCPNGGLIQAGVNWCVENGVTSFAAWHEWWPAEAMQYWDNVSVSAGDSITVTITASNTEAGSATLINNTTGQRVRFVWTYKTPSLCEATAEWIVEDYSIGNNLVAFADYGSVTFTGNSAVIHGATTSDLSNSYIANMVSVSNPSQVISASTVNGNAITVVYQ

SEQ ID NO: 143 - protein, 270 aa, Penicillium chrysogenum; identical to SEQ ID NO: 128

SEQ ID NO: 144 - protein, 282 aa, Aspergillus niger
MKFSTILTGSLFATAALAAPLTEKRRARKEARAAGKRHSNPPYIPGSDKEILKLNGTTNEEYSSNWAGAVLIGDGYTKVTGEFTVPSVSAGSSGSSGYGGGYGYWKNKRQSEEYCASAWVGIDGDTCETAILQTGVDFCYEDGQTSYDAWYEWYPDYAYDFSDITISEGDSIKVTVEATSKSSGSATVENLTTGQSVTHTFSGNVEGDLCETNAEWIVEDFESGDSLVAFADFGSVTFTNAEATSGGSTVGPSDATVMDIEQDGSVLTETSVSGDSVTVTYV

SEQ ID NO: 145 - protein, 612 aa, Trichoderma reesei
MAKLSTLRLASLLSLVSVQVSASVHLLESLEKLPHGWKAAETPSPSSQIVLQVALTQQNIDQLESRLAAVSTPTSSTYGKYLDVDEINSIFAPSDASSSAVESWLQSHGVTSYTKQGSSIWFQTNISTANAMLSTNFHTYSDLTGAKKVRTLKYSIPESLIGHVDLISPTTYFGTTKAMRKLKSSGVSPAADALAARQEPSSCKGTLVFEGETFNVFQPDCLRTEYSVDGYTPSVKSGSRIGFGSFLNESASFADQALFEKHFNIPSQNFSVVLINGGTDLPQPPSDANDGEANLDAQTILTIAHPLPITEFITAGSPPYFPDPVEPAGTPNENEPYLQYYEFLLSKSNAEIPQVITNSYGDEEQTVPRSYAVRVCNLIGLLGLRGISVLHSSGDEGVGASCVATNSTTPQFNPIFPATCPYVTSVGGTVSFNPEVAWAGSSGGFSYYFSRPWYQQEAVGTYLEKYVSAETKKYYGPYVDFSGRGFPDVAAHSVSPDYPVFQGGELTPSGGTSAASPVVAAIVALLNDARLREGKPTLGFLNPLIYLHASKGFTDITSGQSEGCNGNNTQTGSPLPGAGFIAGAHWNATKGWDPTTGFGVPNLKKLLALVRF

SEQ ID NO: 146 - protein, 609 aa, Trichoderma atroviride
MAKLTALAGLLTLASVQANAAVLLDSLDKVPVGWQAASAPAPSSKITLQVALTQQNIDQLESKLAAVSTPNSSNYGKYLDVDEINQIFAPSSASTAAVESWLKSYGVDYKVQGSSIWFQTDVSTANKMLSTNFHTYTDSVGAKKVRTLQYSVPETLADHIDLISPTTYFGTSKAMRALKIQNAASAVSPLAARQEPSSCKGTIEFENRTFNVFQPDCLRTEYSVNGYKPSAKSGSRIGFGSFLNQSASSSDLALFEKHFGFASQGFSVELINGGSNPQPPTDANDGEANLDAQNIVSFVQPLPITEFIAGGTAPYFPDPVEPAGTPDENEPYLEYYEYLLSKSNKELPQVITNSYGDEEQTVPQAYAVRVCNLIGLMGLRGISILESSGDEGVGASCLATNSTTTPQFNPIFPATCPYVTSVGGTVSFNPEVAWDGSSGGFSYYFSRPWYQEAAVGTYLNKYVSEETKEYYKSYVDFSGRGFPDVAAHSVSPDYPVFQGGELTPSGGTSAASPIVASVIALLNDARLRAGKPALGFLNPLIYGYAYKGFTDITSGQAVGCNGNNTQTGGPLPGAGVIPGAFWNATKGWDPTTGFGVPNFKKLLELVRYI

SEQ ID NO: 147 - protein, 612 aa, Trichoderma virens
MPKSTALRLVSLLSLASVPISASVLVESLEKLPHGWKAASAPSPSSQITLQVALTQQNIDQLESRLAAVSTPNSKTYGNYLDLDEINEIFAPSDASSAAVESWLHSHGVTKYTKQGSSIWFQTEVSTANAMLSTNFHTYSDAAGVKKLRTLQYSIPESLVGHVDLISPTTYFGTSNAMRALRSKSVASVAQSVAARQEPSSCKGTLVFEGRTFNVFQPDCLRTEYNVNGYTPSAKSGSRIGFGSFLNQSASFSDLALFEKHFGFSSQNFSVVLINGGTDLPQPPSDDNDGEANLDVQNILTIAHPLPITEFITAGSPPYFPDPVEPAGTPDENEPYLQYFEYLLSKPNRDLPQVITNSYGDEEQTVPQAYAVRVCNLIGLMGLRGISILESSGDEGVGASCVATNSTTPQFNPIFPATCPYVTSVGGTVNFNPEVAWDGSSGGFSYYFSRPWYQEEAVGNYLEKHVSAETKKYYGPYVDFSGRGFPDVAAHSVSPDYPVFQGGQLTPSGGTSAASPVVASIIALLNDARLREGKPTLGFLNPLIYQYAYKGFTDITSGQSDGCNGNNTQTDAPLPGAGVVLGAHWNATKGWDPTTGFGVPNFKKLLELIRYI

SEQ ID NO: 148 - protein, 594 aa, Aspergillus fumigatus
MLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGKEQNSALSSHAVKLPALPRRAATNSSCANLITPDCLVEMYNLGDYKPDASSGSRVGFGSFLNESANYADLAAYEQLFNIPPQNFSVELINRGVNDQNWATASLGEANLDVELIVAVSHPLPVVEFITGGSPPFVPNADEPTAADNQNEPYLQYYEYLLSKPNSHLPQVISNSYGDDEQTVPEYYARRVCNLIGLMGLRGITVLESSGDTGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAHSLTPYYEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 149 - protein, 594 aa, Aspergillus oryzae
MRSSFLLAGVFGSLAAPALAIVHEKVAAVPNGWTLVKQAPESDPITLSIALARQNLDQLESKLTALSTPGNAEYGQWLDQSGIETLFPTASDEAVLRWLRNAGVTHISRQGGLVNFATSVGTVNKLFDTKFSYYKNGQVQKLRTTQYSIPDDLADGIDLVAPTVFFGKQQESVALPTHHKFAAGTKTAAGNVSCADIITPDCLADMYNFRGYKPSASSGSKVGFGSFLNESANYVDLALYEKRFNIPSQNFSVELINGATNDQNWTTASLGEANLDVELIVGVSHPLPVKEYITAGTPPFIPNALQPTPADNQNEPYLEYYEYLLAKPNSALPQVLSNSYGDEEQTVPEYYAKRVCNLIGLMGLRGITVLESSGDTGIGASCMSNDGTETPEFTPIFPATCPYLTSVGGTQAYAPEVAWDASSGGFSNYFSRAWYQESAVSKYLDQQITAETKDYYSQYTNFSGRGFPDVAAHSLTPRYEVVVKGKRATSGGTSAAAPVFAGLVGMLNDARLRAGKPTLGFLNPLLYSGALKDFTDITAGSSIGCDGVNPQTGKNVTGGGVIPYAHWNATAGWDPVTGLGVPDFMKLKDLVLSL

SEQ ID NO: 150 - protein, 595 aa, Aspergillus niger
MRSSGLYTALLCSLAASTNAIVHEKLAAVPSGWHHVEDAGSDHQISLSIALARKNLDQLESKLKDLSTPGESQYGQWLDQEDVDTLFPVASDKAVINWLRSANITHISRQGSLVNFATTVDKVNKLLNATFAYYQSGSSQRLRTTEYSIPDDLVDSIDLISPTTFFGKEKTTAGLNQRAQKIDTHVAKRSNSSSCADVITLSCLKEMYNFGNYTPSASSGSKLGFGSFLNESASYSDLAKFEKLFNLPSQSFSVELVNGGVNDQNQSTASLTEADLDVELLVGVAHPLPVTEFITSGEPPFIPDPDEPSAADNENEPYLQYYEYLLSKPNSALPQVISNSYGDDEQTVPEYYAKRVCNLIGLVGLRGISVLESSGDEGIGSGCRTTDGTNRTQFNPIFPATCPYVTAVGGTMSYAPEIAWEASSGGFSNYFERAWFQKEAVQNYLAHHITNETKQYYSQFANFSGRGFPDVAAHSFEPSYEVIFYGARYGSGGTSAACPLFSALVGMLNDARLRAGKSTLGFLNPLLYSKGYRALTDVTGGQSIGCNGIDPQNDETVAGAGIIPWAHWNATVGWDPVTGLGLPDFEKLRQLVLSL

SEQ ID NO: 151 - protein, 594 aa, Aspergillus clavatus
MLSSTLYAGLLCSLAAPAFGIAHEKLAAVPNGWTLIKDAPETDTITLSIALARQNLDQLESKLTTLATPGNAEYGQWLDKADIESLFPTASDEAIIEWLKAAGITQVSRQGSLVNFASTVGTVNKLFNTTFSYYQNGASQKLRTTEYSIPDSLTDAIDLVAPTVFFGKDQDNALPSFASKLPTLPKRASNSSSCADLITPACLAEMYNLGDYKPVVSSGSRIGFGSFLNESANYADLAAYEKLFKIPSQNFSVELINGGTNDQNWNTAQLGEADLDVELIVAVSHPLPVVEYITGGSPPYVPNADGPTAADNQNEPYLEYYEYLLSKPNAALPQVISNSYGDDEQTVPKYYAKRVCNMIGLMGLRGITVLESSGDTGIGSACMSNDGTNTPQFTPTFPGTCPFITSVGGTQAYAPEVAWDGSSGGFSNYFKRPRYQEAAVKSYLKHHISKDTKEYYSQYTNFHGRGFPDVSAHSLTPDYEVINYGARSRSGGTSAACPVFAGIVGMLNDARLRAGKPTLGFLNPLLYSEGFKTFTDITAGASVGCDGTNPQSGKPVPGGGIIPYAHWNATAGWDPVTGLGVPNFLKLKELVLSF

SEQ ID NO: 152 - protein, 580 aa, Aspergillus niger
MVAFSRISAGFALAAPALASVVLETVKSVPSDWKLVEAADTSSTISLSVALARQNLDQLEEKLLAVSTPGKDTYGQFLDLDDINEQFPLADDAAVVAWLKKAGVTQIHKEGGLLNFATTVGTANQLLNTTFSVYKSGSTQKLRTTQYSVPDELTGSIDLISPTVFFGKSNAARSAAVRASQTTKETSRKKSSNVCEYITPDCLKEQYSIDYTPEASSGSRVGFGSFLNESALYSDLDLFTQYFDIPQQSFTVETINGGINNQENDPDGEADLDVQNIVGISHPLPVTEYITGGSPPFIPDVETTTDENEPYLQYYEYLLAKTNDELPLVISNSYGDDEDTVPIAYATRVCNLIGLMGTRGISILESSGDSGVGGACMSNDGTDKTEFTPMFPGTCPYITAVGGTQDVPEVAWVDSSGGFSNYFSQPSYQSDQVETYLDKYISASTKKYYEQYTNFSGRAFPDVSAFAGSPYYETYIDGQLGLVAGTSGASPVFAGIVALLNDARLRANKTSLGFLNPWLYSSGYKSLNDITSGEAVGCQGDVEGAGVIPWASWNATTGWDPATGLGTPNFAKLKEAVLAL

SEQ ID NO: 153 - protein, 602 aa, Aspergillus clavatus
MFSSLFSRGALSLAVVSLLTSSVAAEVFEKLSTVPQGWKYSHAPSDSDPIRLQIALQQQDVDGFEKALLEMSDPSHASYGKHFQSHEEMKRMLLPSQESVQSVRSWLESGGVTDIEEDADWINFRTTVGVANTLLDADFKWYVSDVRSLERLRTLSYSIPESLASHVHMIQPTTRFGQIKANRATLHSSSLYRDEKILSASLQAGNSTCDQVITPQCLKSLYNIGDYKADARSGSKVAFASFLEEYARYDDLAKFEEKLAPYAIGQNFSVIQYNGGLNDQNSTSDSGEANLDLQYMLGISAPLPITEFSTGGRGKLIPDLSSPDPNDNSNEPYLEFLQNVLKMPQHKLPQVISTSYGEDEQTIPKRYALSVCNLYAQLGSRGVSVIFSSGDSGVGAACQTNDGHNTTHFPPQFPAACPWVTSVGGTTNTQPEEAVYFSSGGFSDLWPRPGYQEVAVRGYLKKLGGTYRGLYNPRGRAFPDVAAQAMKYAVFDKGALHQYAGTSCSAPAFGGIIGLLNDARLRAHKPPMGFLNPWLYSQASHGFNDIVVGGSKGCDGRNRFGGTPNGSPVVPYASWNATEGWDPATGLGTPNFGKLLHLALRR

SEQ ID NO: 154 - protein, 600 aa, Aspergillus terreus
MLPSLVNNGALSLAVLSLLTSSVAGEVFEKLSAVPKGWHFSHAAQADAPINLKIALKQHDVEGFEQALLDMSTPGHENYGKHFHEHDEMKRMLLPSDSAVDAVQTWLTSAGITDYDLDADWINLRTTVEHANALLDTQFGWYENEVRHITRLRTLQYSIPETVAAHINMVQPTTRFGQIRPDRATFHAHHTSDARILSALAAASNSTSCDSVITPKCLKDLYKVGDYEADPDSGSQVAFASYLEEYARYADMVKFQNSLAPYAKGQNFSVVLYNGGVNDQSSSADSGEANLDLQTIMGLSAPLPITEYITGGRGKLIPDLSQPNPNDNSNEPYLEFLQNILKLDQDELPQVISTSYGEDEQTIPRGYAESVCNMLAQLGSRGVSVVFSSGDSGVGAACQTNDGRNQTHFNPQFPASCPWVTSVGATTKTNPEQAVYFSSGGFSDFWKRPKYQDEAVAAYLDTLGDKFAGLFNKGGRAFPDVAAQGMNYAIYDKGTLGRLDGTSCSAPAFSAIISLLNDARLREGKPTMGFLNPWLYGEGREALNDVVVGGSKGCDGRDRFGGKPNGSPVVPFASWNATQGWDPVTGLGTPNFAKMLELAP

SEQ ID NO: 155 - protein, 602 aa, Aspergillus fumigatus
MFSSLLNRGALLAVVSLLSSSVAAEVFEKLSAVPQGWKYSHTPSDRDPIRLQIALKQHDVEGFETALLEMSDPYHPNYGKHFQTHEEMKRMLLPTQEAVESVRGWLESAGISDIEEDADWIKFRTTVGVANDLLDADFKWYVNEVGHVERLRTLAYSLPQSVASHVNMVQPTTRFGQIKPNRATMRGRPVQVDADILSAAVQAGDTSTCDQVITPQCLKDLYNIGDYKADPNGGSKVAFASFLEEYARYDDLAKFEEKLAPYAIGQNFSVIQYNGGLNDQNSASDSGEANLDLQYIVGVSSPIPVTEFSTGGRGLLIPDLSQPDPNDNSNEPYLEFLQNVLKMDQDKLPQVISTSYGEDEQTIPEKYARSVCNLYAQLGSRGVSVIFSSGDSGVGAACLTNDGTNRTHFPPQFPAACPWVTSVGGTTKTQPEEAVYFSSGGFSDLWERPSWQDSAVKRYLKKLGPRYKGLYNPKGRAFPDVAAQAENYAVFDKGVLHQFDGTSCSAPAFSAIVALLNDARLRAHKPVMGFLNPWLYSKASKGFNDIVKGGSKGCDGRNRFGGTPNGSPVVPYASWNATDGWDPATGLGTPDFGKLLSLAMRR

SEQ ID NO: 156 - protein, 595 aa, Sclerotinia sclerotiorum
MMYPKTAICAGLLSQALPAYGAVMEKLAAVPSGWTVAETDSSTAITLTVGLAMQNLDQLEAKLIAVSTPGNADYGNHLDADEANALFAPSADASNAVTSWLTSAGAQNIVSDGSTVTFAATIEKANSILNATFQTYTSNGVTKVRTTQYSVPDHLAEHIDLISPTTYFGKTVANAPTKVTKKDTSATKVTVDASCSTSITPKCIKELYNVGDYTPSVSSGSRIGFGSFLNQSALYSDLFQYEKYFDIPQQNFSVTLINGATNDQNPATAQNGEANLDVQNIIGVAHPLPVQEFITGGSPPFVPNIDVPTAADNSNEPYLPYYQYLMTQPNSAIPQVISNSYGDDEDTVPYAYAVRVCNLIGIMGLRGISILESSGDTGVGAGCVANDGKDTPYFQPQFPGTCPYITSVGGTQSVSPEVAWDDGSGGFSNYFPTAWYQTAAVAEYLTEHITPSTRKYYESYTNFSGRGFPDISAHSLTPDYQVVYSGELSPSGGTSAAAPVVAAILGLLNDARFKAGKSALGFVNPLLYLLGTSALNDITGGGSVGCNGVNGQTGAKIPNGAVIPYATWNATKGWDPVTGLGTPDFEKLKELVLSY

SEQ ID NO: 157 - protein, 595 aa, Botryotinia fuckeliana
MYPKTAICAGLLSQALPAYGAVMEKLAAAPSGWTAASETDSSAAITLTVGLAMQNLDQLEAKLLAVSTPGNAEYGNHLDIDEANALFAPSADASSAVTSWLTSAGAQNIVSDGSTISFATTIEKANSMLNAKFKSYTSNGVTKVRTTQYSVPDDVAEHIELISPTTYFGKTVANAPTKIAKRDTSATKVTVDAACSTSITPKCIKELYNIGDYTPSVSSGSRIGFGSFLNQSALYTDLFQYESYFGIPEQNFTVTLINGATNDQNEATAQIGEANLDVQNIIGVAHPLPVQEFITGGSPPFIPNVDLPTEADNSNEPYLPYYEYLLSQPNSALPQVISNSYGDDEDTVPYAYAVRVCNLIGIMGLRGISVLESSGDTGVGAGCVANDGLNTPYFQPQFPGTCPYITSVGGTQAVAPEVAWDDGSGGFSNYFPTAWYQVAAVDEYLNKHISPSTKEYYESYTNFSGRGFPDISAHSLTPDYQVVYFGELSPSGGTSAAAPVIAGILGLLNDARFKAGKPALGFINPLLYLLGQGALNDITGGASVGCNGVNGQTGAKVPGGAVIPYASWNATKGWDPVTGLGTPNFEKLKALVLSY

SEQ ID NO: 158 - protein, 594 aa, Neosartorya fischeri
MLSSTLYAGLLCSLAAPALGVVHEKLSAVPSGWTLVEDASESDTTTLSIALARQNLDQLESKLTTLATPGNAEYGKWLDQSDIESLFPTASDDAVIQWLKDAGVTQVSRQGSLVNFATTVGTANKLFDTKFSYYRNGASQKLRTTQYSIPDSLTESIDLIAPTVFFGKEQDSALPPHAVKLPALPRRAATNSSCANLITPDCLVEMYNLGDYKPDASSGSRVGFGSFLNQSANYADLAAYEQLFNIPPQNFSVELINGGANDQNWATASLGEANLDVELIVAVSHALPVVEFITGGSPPFVPNVDEPTAADNQNEPYLQYYEYLLSKPNSHLPQVISNSYGDDEQTVPEYYARRVCNLIGLMGLRGITVLESSGDTGIGSACMSNDGTNTPQFTPTFPGTCPFITAVGGTQSYAPEVAWDASSGGFSNYFSRPWYQYFAVENYLNNHITKDTKKYYSQYTNFKGRGFPDVSAHSLTPDYEVVLTGKHYKSGGTSAACPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 159 - protein, 605 aa, Talaromyces stipitatus
MSRNLLVGAGLLALAQLSGQALAAAALVGHESLAALPVGWDKVSTPAAGTNIQLSVALALQNIEQLEDHLKSVSTPGSASYGQYLDSDGIAAQYGPSDASVEAVTNWLKEAGVTDIYNNGQSIHFATSVSKANSLLGADFNYYSDGSATKLRTLAYSVPSDLKEAIDLVSPTTYFGKTTASRSIQAYKNKRASTTSKSGSSSVQVSASCQTSITPACLKQMYNVGNYTPSVAHGSRVGFGSFLNQSAIFDDLFTYEKVNDIPSQNFTKVIIANASNSQDASDGNYGEANLDVQNIVGISHPLPVTEFLTGGSPPFVASLDTPTNQNEPYIPYYEYLLSQKNEDLPQVISNSYGDDEQSVPYKYAIRACNLIGLTGLRGISVLESSGDLGVGAGCRSNDGKNKTQFDPIFPATCPYVTSVGGTQSVTPEIAWVASSGGFSNYFPRTWYQEPAIQTYLGLLDDETKTYYSQYTNFEGRGFPDVSAHSLTPDYQVVGGGYLQPSGGTSAASPVFAGIIALLNDARLAAGKPTLGFLNPFFYLYGYKGLNDITGGQSVGCNGINGQTGAPVPGGGIVPGAAWNSTTGWDPATGLGTPDFQKLKELVLSF

SEQ ID NO: 160 - protein, 604 aa, Penicillium marneffei
MSRNLLVGAGLLALAQLNPVLAASALVSHEALATLPPGWDKVNTPAGHTNIQLSVALTLQNIEQLQSHLQSVSTPGSSGYGQYLDSDDIAAQYGPSDASVDAVTKWLKEAGITEIHNNGQSINFATTVSKANKLLGADFHYYSDGGATKLRTLAYSVPSDLQAAIDLVSPTTYFGKTTASRSIQTYSNKRASTTTKSGSSSVAVAASCQTSITPACLKQMYNVGNYTPSVASGSRVGFGSFLNQSAIYDDLFTYEKVNGIPNQNWTKVIIANAPNDQDPNDGNYGEANLDVQNIVGISHPLPVTEFLTGGSPPFVPSLDTPTNENEPYIPYYEYLLSQKNADLPQVISNSYGDDEQSVPYKYAVRACNLIGLTGLRGITVLESSGDLGVGAGCLSNDGKNKTQFDAIFPATCPYITAVGGTQAVTPEIAWTASSGGFSYYFPRPWYQRKAIETYLGLLDDSTKQYYSQYTNFEGRGFPDVAAHSLLPDYQVVGGGELQRSGGTSAASPVFAGIIALLNDARLSAGKPTLGFLNPFIYYAGYKGLNDITGGKSIGCNGVNGQTGGTVPGGGVVPGAAWNCTTGWDPATGLGTPDFQKLKELVLSF

SEQ ID NO: 161 - protein, 600 aa, Gibberella zeae
MYITSSRLVLALAALPTAFGKSYSHHAEAPKGWKVDDTARVASTGKQQVFSIALTMQNVDQLESKLLDLSSPDSKNYGQWMSQKDVTTAFYPSKEAVSSVTKWLKSKGVKHYNVNGGFIDFALDVKGANALLDSDYQYYTKEGQTKLRTLSYSIPDDVAEHVQFVDPSTNFGGTLAFAPVTHPSRTLTERKNKPTKSTVDASCQTSITPSCLKQMYNIGDYTPKVESGSTIGFSSFLGESAIYSDVFLFEEKFGIPTQNFTTVLINNGTDDQNTAHKNFGEADLDAENIVGIAHPLPFTQYITGGSPPFLPNIDQPTAADNQNEPYVPFFRYLLSQKEVPAVVSTSYGDEEDSVPREYATMTCNLIGLLGLRGISVIFSSGDIGVGAGCLGPDHKTVEFNAIFPATCPYLTSVGGTVDVTPEIAWEGSSGGFSKYFPRPSYQDKAVKTYMKTVSKQTKKYYGPYTNWEGRGFPDVAGHSVSPNYEVIYAGKQSASGGTSAAAPVWAAIVGLLNDARFRAGKPSLGWLNPLVYKYGPKVLTDITGGYAIGCDGNNTQSGKPEPAGSGIVPGARWNATAGWDPVTGYGTPDFGKLKDLVLSF

SEQ ID NO: 162 - protein, 599 aa, Fusarium oxysporum
MYISSQNLVLALSALPSAFGKSFSHHAEAPQGWQVQKAAKVASNTQHVFSLALTMQNVDQLESKLLDLSSPDSANYGNWLSHDELTSTFSPSKEAVASVTKWLKSKGIKHYKVNGAFIDFAADVEKANTLLGGDYQYYTKDGQTKLRTLSYSIPDDVAGHVQFVDPSTNFGGTVAFNPVPHPSRTLQERKVSPSKSTVDASCQTSITPSCLKQMYNVGDYTPDAKSGSEIGFSSFLGQAAIYSDVFKFEELFGIPKQNYTTILINNGTDDQNTAHKNYGEANLDAENIVGIAHPLPFKQYITGGSPPFVPNIDQPTEKDNQNEPYVPFFRYLLGQKDLPAVISTSYGDEEDSVPREYATLTCNMIGLLGLRGISVIFSSGDIGVGSGCLAPDYKTVEFNAIFPATCPYLTSVGGTVDVTPEIAWEGSSGGFSKYFPRPSYQDKAIKKYMKTVSKETKKYYGPYTNWEGRGFPDVAGHSVAPDYEVIYNGKQARSGGTSAAAPVWAAIVGLLNDARFKAGKKSLGWLNPLIYKHGPKVLTDITGGYAIGCDGNNTQSGQPEPAGSGLVPGARWNATAGWDPTTGYGTPNFQKLKDLVLSF

SEQ ID NO: 163 - protein, 637 aa, Grosmannia clavigera
MATEHHARTRAAVVLHTLRGSMATLALAVSSLLLLPAAEAAVISSIDTVPKGWSVAPAAKINARTSSAQVFTIALALQNIDQLESHLLSVSSPNSASYGAHEDVEGITAKYGPSDEAVQVVTAWLKSSSAVQTFSVRDGFVDVAATVDGANTLFNASYDFYTHEANAATTKLRTLSYSVPDHVAAHVALVDPGNYFGKTAAFAPRRGAPAPVPASKTARSPSLVKARGTSTTIDAACSTSITPACLKQLYNVGNYTPDASSGSRVGFGSFLNQSALYADVFTYEERNGIAAQNFTVELIANATNDQDKWTASVDEANLDVQNIIGVSHPLPVIEYITGGSPPFVADIDLPSAAENQNEPYLPYLSYLLAKSNSELPQAISNSYGDEEDSVPYNYANYTCNLIGMLGLRGITVLHSSGDMGVGAGCLAPDNTTVEFNPIYPATCPYVTAVGGTVNVSPEIAWKGSSGGFSKYFPRPSYQDKAVSEYLSDHVNASTVKYYAPYTNFSGRGFPDVSAHSVSPAYEIIYFDQPGPSGGTSAAAPVWAGIVGLLNDARLRSGKSTLGWLNPLIYTYGPSVLNDITDGYSVGCNGVNYQTDQYEPAGAGIVPGAHWNATVGWDPVTGYGTPNFEELKKVVLGL

SEQ ID NO: 164 - protein, 594 aa, Verticillium albo-atrum
MVLPKLHACVSRAATLPASIQLIRQAPAGDEIQLQIALKHQNIHKLESTLRSVSDPSSSHYGQYLSKDEVNALFAPSNHSRTAVESWLKDAGITAVSTRGPLVDFVTTVAKANELLGADFAWFDVEGHKKLRTTEYSIPDTLTAHIDLVAPTTFFGRTKSHRMIPDDETSELDARQARNTTTCLSVITPDCLEEAYNYGSYKADPAAGSRVAFASFLNQSARQEDLTQYLNTFKLPPRNFTTVLINGGEDHQDPNGDIGEANLDAQFLAAVTKNLPLKQFITGGSPPFVPNLRITNASTNSNEPYLDFYETLLATDDEGVPQVLSSSYGDDEQTVPVEYAKRVCNLIGMMGLRGVTVLESSGDAGVGAPCRANDGSGRAEFTPTFPGTCPYLTAVGGTQAWAPEVAWVGSAGGFSNYFERAWYQKAAVKTYLKESIPAEVKSYYKHGGFVDFGGRGFPDISAHSLEPWYQFVNAGRPRRTGGTSAAAPVVAGIIGLLNDARLRAGQPTMGFLNPWLYARGVDGLLDVTEGKAEGCGGIDLQSGNPVPGAGVIPWASWNATKGAATDCGQWHQGMIWCCWVPVVAMYLEMLREQG

SEQ ID NO: 165 - protein, 566 aa, Verticillium dahliae
MVLLKLHACVAATLVALTEALLVSRAATLPASIQLIRQAPAGDEIQLQIALKHQNIHKLESKLRSVSDPSSSHYGQYLSKDEVNALFAPSNHSRTAVESWLKDAGITAVSSRGPLVDFVTTVAKANELLGADFAWFDVEGHKKLRTTEYSIPDTLTAHIDLVAPTTFFGRTKSHRMIPDDETSELDSRQARNTTTCLSVITPDCLEEAYNYGSYKADPAAGSRVAFASFLNQSARQEDLTQYLNTFKLPPRNFTTVLINGGEDHQDPNGDIGEANLDAQFLAAVTKNLPLKQFITGGSPPFVPNLRITNASTNSNEPYLDFYETLLATDDEGVPQVLSSSYGDDEQTVPVEYAKRVCNLIGMMGLRGVTVLESSGDAGAWAPEVAWVGSAGGFSNYFERAWYQKAAVKTYLEESIPVEVKSYYKRGGFVDFGGRGFPDISAHSLEPWYQFVNAGRPRRTGGTSAAAPVVAGIIGLLNDARLRAGQPTMGFLNPWLYARGVDGLLDVTEGKAEGCGGIDLQSGNPVPGAGVIPWASWNATKGWDPVTGLGLPDFEALRQIAVNGTKA

SEQ ID NO: 166 - protein, 391 aa, Trichoderma reesei
MRLSVLLSVLPLVLAAPAIEKRAEPAPLLVPTTKHGLVADKYIVKFKDGSSLQAVDEAISGLVSNADHVYQHVFRGFAATLDKETLEALRNHPEVDYIEQDAVVKINAYVSQTGAPWGLGRISHKARGSTTYVYDDSAGAGTCSYVIDTGVDATHPDFEGRATLLRSFVSGQNTDGNGHGTHVSGTIGSRTYGVAKKTQIYGVKVLDNSGSGSFSTVIAGMDYVASDSQTRNCPNGSVANMSLGGGYTASVNQAAARLIQAGVFLAVAAGNDGVDARNTSPASEPTVCTVGASTSSDARASFSNYGSVVDIFAPGQDILSTWPNRQTNTISGTSMATPHIVGLGAYLAGLEGFSDPQALCARIQSLANRNLLSGIPSGTINAIAFNGNPSG

SEQ ID NO: 167 - protein, 371 aa, Trichoderma atroviride
MAAPSRRASPAPVLVPRGAQVLEGRYIVKMKTEAQVSAVESALSGVSAGASHRYSHSFSGFAASLTPGELEILQNDPNVDFIEQDATVSTKAIVTEGSADWGLSRISNKKPDTTRYSYDSSAGEGTCAFVIDTGIDVHHPEFEGRAKFLENFVGDGSDADLFGHGTHVSGIIAGKTFGVAKKASLFAVKVLDVNGQGNNSVIIAGMDYVAKNASSQHCPKGIVVNMSLGGIKTDAVNQAAISITNAGLFLAAAAGNDALDAADFSPACVPAVCTVGATDRNDTFALYSNRGSAVDILAPGTNITSSWPGNLTKVMSGTSMASPHVAGLGAYLLGLGQKIGGLCGTISSSALKGAIKGVPESTVNLLVQNGA

SEQ ID NO: 168 - protein, 391 aa, Trichoderma virens
MRLSVLLSLLPMVLAAPAIEKRAEPAPLFKPTSKHGLVADQYIVKFKEGSSLQAVDETLTRIASDAHHVYQHVFNGFAGKLDQETLEALRNHPDVEYIEQDAIVKVNAFVQQTGAPWGLGRISHKARGSTTYVYDDSAGAGTCAYIIDTGVDATHPEFEGRATFLKTYVSGQNTDGNGHGTHVAGTIGSRSYGVAKKTQLFGVKVLDNSGSGTFANVIAGMDFVASDSKTRNCPNGSVANMSLGGGVSSAVNEAAAALIAADVFLAVAAGNDGTDARNTSPASEPTVCTVGATTSADARASFSNYGSVVDIFAPGQDILSTWPSGRTNTISGTSMATPHIVGLGAYLLSLEGHIAPQALCSRIQSLAGKSLLSGIPSGTINAVAFNGNPSG

SEQ ID NO: 169 - protein, 391 aa, Hypocrea koningii
MRLSVLLSVLPLVLVAPATEKRAEPAPLLVPTTKHGLVADKYIVKFKDGSSLQAVDEAISGLVSNADHVYQHVFRGFAATLDKKTLETLRNHPEVDYIEQDAVVKINSYVSQSGAPWGLGRISHKARGSTTYVYDDSAGAGTCSYVIDTGVDAAHPDFEGRATLLRSFVSGQNTDGNGHGTHVSGTIGSRTYGVAKKTQIYGIKVLDNSGSGSFSTVIAGMDYVASDSQTRNCPNGSVANMSLGGGYTASVNQAAARLIQAGVFLAVAAGNDGVDARNTSPASEPSVCTVGASTSSDARASFSNYGSVVDIFAPGQDILSTWPNRQTNAISGTSMATPHIVGLGAYLAGLEGFSDPQALCARIQALAGRNLLSGIPSGTINAIAFNGNPSG

SEQ ID NO: 170 - protein, 390 aa, Purpureocillium lilacinum
MKLSLLFAILPAVLAAPAVKRDEPAPLLTPRGASQLINGKYIVKFKDGMSIASVDKTVSALSSKADRVYNHIFRGFAGNLNANDLKTLRDHPDVEYIEQDAIITINAYTQQPGAPWGLGRISHRSKGSTTYEYDTSGGSGTCAYVIDTGVEASHPEFEGRASQIKSFISGQNTDGNGHGTHCAGTIGSKTYGVAKKTKIYGVKVLDNSGSGSYSGIISGMDFAVQDSKTRSCPKGVVANMSLGGGKAQSVNDGAAAMIRAGVFLAVAAGNDNANAANYSPASEPTVCTVGATTSSDARSSFSNYGSLVDIFAPGSNILSTWIGGTTNTISGTSMATPHIVGLGAYLAGLEGFPGAQALCKRIQTLSTKNVLTGIPSGTVNYLAFNGNPSG

SEQ ID NO: 171 - protein, 388 aa, Metarhizium anisopliae
MHLSALLTLLPAVLAAPATIGRRAEPAPLFTPQAESIIADKYIVKFKDDIARIATDDTVSALTSKADFVYEHAFHGFAGSLTKEELKMLREHPGVDFIEKDAVMRISGITEQSGAPWGLGRISHRSKGSTTYRYDDSAGQGTCVYIIDTGIEASHPEFEGRATFLKSFISGQNTDGHGHGTHCAGTIGSKTYGVAKKAKLYGVKVLDNQGSGSYSGIISGMDYVAQDSKTRGCPNGAIASMSLGGGYSASVNQGAAALVNSGVFLAVAAGNDNRDAQNTSPASEPSACTVGASAENDSRSSFSNYGRVVDIFAPGSNVLSTWIGGRTNTISGTSMATPHIAGLAAYLSALQGKTTPAALCKKIQDTATKNVLTGVPSGTVNYLAYNGA

SEQ ID NO: 172 - protein, 389 aa, Hirsutella rhossiliensis
MKLSLILAILPAVLAAPATKRDEPAPLLIPRGSKQLIADKYIVKFKDSMSIAAVDKTVKALSNKADHVYTNTFRGFAGQLSAKDVKALRERPDVEYVEQDSIVTINALKQQPGAPWGLGRISHREPGSTTYVYDSSAGQGTCAYVIDTGVEASHPEFEGRATMVRSFINGQATDGHGHGTHCAGTIGSKTYGVAKKTKIYGVKVLSNQGSGAVSVIIAGMDFAVQDSRKRSCPKGVVANMSLGGGFSAAINNAAASMIRSGVFLAVAAGNDNTDASGSSPASEPTVCTVGASTISDQRSSFSNYGSVVDIFAPGSDILSTWIGGRTNTISGTSMATPHIAGLGAYLAGLEGFSDPQALCSRIQELATSDVLTDIPDGTVNKLAFNGASQ

SEQ ID NO: 173 - protein, 389 aa, Tolypocladium inflatum
MRLSILLSILPMVLAAPAAKRDEPAPLLVPRGNHELIADKYIVKFKEGSALSVLEDTMSSLTGNADHVYDVVFKGFAGHLDKVMLDVLRGHPDVEYIEQDAMVTINGFVSQPGATWGLGRVSHRQPGATSYDHDSSAGAGTCAYVIDTGVEASHPEFEGRAAQVKSFINGQNSDGNGHGTHVSGTIGSKSYGIAKKTKIYGVKVLDNQGSGSFSSIIAGMDFVAKDAKTRGCPKGAVANMSLGGGYAASVNQAAAALVNSGVFLGVAAGNSNTDAGSTSPASETSACTVGATDRNDNRSSFSNYGSVVDIFGPGSDILSTWIGGRTNTISGTSMATPHIVGLAAYIGGLEGRTGGAVCNRLQELATRNAIRGVPSGTKNLLAFNGNPSG

SEQ ID NO: 174 - protein, 387 aa, Metacordyceps chlamydosporia
MQLSVLLTLLPAVLAAPAIVEQRAEPAPLFTPKSSIIAGKYIVKFKDGVARIAADEATSALSAKADHVYSHLFNGFAGSLTKEELQTLRNHPDVDFIEKDAVMTANAIVEQQGAPWGLGRISNRQKGSTTYRYDDSAGNGACVYVLDTGIETTHPEFEGRATWLKSFIDGENNDGHGHGTHCAGTVGSKTYGVAKKAKLLAVKVLDNGGSGSYAGVIAGMEFVSQDYKTRGCPNGAIASMSLGGPFSASVNQAAAAMVSSGVFLSVAAGNDGADAARYSPASEPSACTVGATTSTDARSSFSNFGKLVDIFAPGSAILSTWINGGTRSISGTSMATPHVAGLAAYLNALQGVVSPAALCKKIQDTAIKNALTGVPASTVNFLAYNGA

SEQ ID NO: 175 - protein, 387 aa, Cordyceps militaris
MRLSLLLAILPVALAAPATKRDEPAPLHAAAVESAAIPGKYIVKFKKGSASADNRMHIMAEHAEHVYTNVMQGFAGSLDAETLKALRNHPDVEYIEQDARVSINGWVTQPQSTWGLSRISHRAKTAKGYTYDSSSGEGTCVYVIDTGIDDSHPDFGGRALQVKSFVDGEPADGHGHGTHCAGTIASNTYGVAKKTKVFGVKVLDNNGSGSWSNVIAGMDFVVNDSRERDCPSGTLASMSLGGGYSAAINGGAAELVSSGVFVSVAAGNDNRDAANYSPASEESACTVGATTSADARSAFSNYGRIVDIFAPGSNILSLAPGGGTATMSGTSMAAPHIAGLAAYIGGLEGLTGGSICNRLVQLATRGTLAGIPGGTVNLLAFNGNPSG

SEQ ID NO: 176 - protein, 379 aa, Fusarium sp.
MRLSIIAVLPLALAAPVLEPAPLLEARGSQPIAGKYIVKLKDTAKIGIMEATAKVANPERVYQNVIKGFSASLCKEEVERLRHDPDVESIEQDAIISINAITQQQGATWGLTRISHRQRGSTAYAYDTTAGQGACAYVIDTGVEDTHPEFEGRAKQIKTFASTARDGNGHGTHCSGTIGSKTYGVAKKVSIFGVKVLDDNGSGSLSNVIAGMDFVASDYRSRNCPRGVVASMSLGGGYSATVNQAAARLQSSGVFVAVAAGNDNRDAANTSPASEPSVCTVGATDSSDRRSSFSNYGRALDIFAPGTDITSTWIGGRTNTISGTSMATPHIAGLGAYLLALEGGSASTICARIQTLSTKNAISGVPSGTVNYLAFNNAT

SEQ ID NO: 177 - protein, 383 aa, Neurospora tetrasperma
MAAPSAPIDKRAPILEARAGTQAVPGKYIVKLRETASDDDLDKAVKKLGNSKADHVYKHAFRGFAGRIDDKTLDEIRSIPEVEYVEQEAVFTINTYTSQSSVPSWGLARLSSKTKGKTTYVYDSSAGAGTCAYIIDTGINTAHSDFGGRATWLANYAGDGINSDGNGHGTHVAGTVGGTTYGVAKKTNLYAVKVLDSNGSGSNSGVIAGMNFVAQDAQSRNCPNGTVANMSLGGGYSASTNSAAAAMVRAGVFLAVAAGNDGANAANYSPASEPTVCTVGATTSADAIAYYSNYGTIVDIFAPGTSITSAWIGSTTAKNTISGTSMATPHITGLGAYLLTLLGKKSPAALCSYIASTANSGVISGIPSGTVNKLAFNGNPSAS

SEQ ID NO: 178 - protein, 393 aa, Chaetomium globosum
MHFSVALLALLPAAIAAPTAEPIQKRAPIIAARVGQVVPNKYLIKLREGTSDDALEAAIGKLGKSKADHIYRGKKFRGFAGKLEADLLDQIRLLPEVEYVEEDAIFSINAYVSQSGAPWGISRLSHKSAGSTTYVYDSSAGEGTCSYVIDTGIYTAHSDFGGRATFAANFVDSSNTDGNGHGTHVAGTIGSTTYGVAKKTKLYAVKVLGSDGSGSTSGVVAGINFVATDAPKRSCPKGVVANMSLGGGYSASINQAAAALVDAGIFLAVAAGNDNANSANYSPASEASVCTVGATDSSDRKASYSNYGSVVDIQAPGTNILSTWIGGRTNTISGTSMASPHIAGLAAYLLALEGSKTPAALCNYIKSTALSGAVSGLPSGTTNRLAFNGNPSA

SEQ ID NO: 179 - protein, 396 aa, Neurospora crassa
MKLSAVLALLPLAMAAPSAPIDKRAPILEARAGTQAVPGKYIVKLRETASDDDLDKAVKKLGNSKADHVYKHAFRGFAGRIDDKTLDDIRSLPEVEYVEQEAVFTINTYTSQSSVPSWGLARLSSKTTGKTTYVYDSSAGAGTCAYIIDTGINTAHSDFGGRATWLANYAGDGINSDGNGHGTHVAGTVGGTTYGVAKKTQLYAVKVLDSNGSGSNSGVIAGMNFVAQDAQSRNCPNGTVANMSLGGGYSASTNSAAAAMVRAGVFLAVAAGNDGANAANYSPASEPTVCTVGATTSADAIAYYSNYGTIVDIFAPGTSITSAWIGSTTAKNTISGTSMATPHITGLGAYLLTLLGKKSPAALCSYIASTANSGVISGIPRGTVNKLAFNGNPSAY

SEQ ID NO: 180 - protein, 397 aa, Fusarium oxysporum
MRSATLLALLPFALAAPSRRAEPAPILRPRGVKLVDGKYIVKMKNGFQASSIESWVDKMIDSIEADADYTYSKGFGGFAASLKDDELNKLKHDPNVEYIEQDAYISITATTQQSNAPWGIARVSSQSPGGSTYTYDDSAGEGTCAYVIDTGIDVDHPDFDGRAKFLKNFAGGSDSDGQGHGTHVAGTIGSTTYGVAKKTSLFAVKVLGDDGSGTNSAVIAGMDFVSGHAKDENCPNGVVVNMSLGGETSDAVNQAAKAIVDAGLFLAVAAGNDGKDASGSSPASEESACTVGATTRDDTLADYSNFGSVVDVLAPGTDILSTWPNGKTNTISGTSMASPHVAGLAAYFLGLGQKAEGLCDYIASKALDGVISNVPSGTVNKLINNGVGGSNSSSIRH

SEQ ID NO: 181 - protein, 389 aa, Gibberella zeae
MRSATLLALLPFALAAPSASVSRRTEPAPVIRPRGVKLVDGKYIVKMKAGVRAASVDSAVSTIQADADYTYTKSFSGFAASLKDEEIETLKHDPNVEYIEQDAVITIKATVDQDNAPWGIARLSSSKPGSKTYTYDESAGEGTCSYVIDTGIDVEHPDFDGRAKFLKNFAGGRDGDGQGHGTHVAGTIGSTTYGVAKKTTLYAVKVLGDDGSGTNSAVIAGMDFVAGHADDENCPNGAVVNMSLGGEASDAVNSAAKSIVDAGLFLAVAAGNEAVDASGSSPASEASACTVGATTRNDTLSYFSNFGDLVDVLAPGTDILSTWPGGKTNTISGTSMASPHVAGLGAYFLGLGKKAEGLCEYIASQALEGVVAQVPRDTVNKLINNGVSK

SEQ ID NO: 182 - protein, 399 aa, Trichoderma reesei
MQPSFGSFLVTVLSASMAAGSVIPSTNANPGSFEIKRSANKAFTGRNGPLALARTYAKYGVEVPKTLVDAIQLVKSIQLAKRDSATVTATPDHDDIEYLVPVKIGTPPQTLNLDFDTGSSDLWVFSSDVDPTSSQGHDIYTPSKSTSSKKLEGASWNITYGDRSSSSGDVYHDIVSVGNLTVKSQAVESARNVSAQFTQGNNDGLVGLAFSSINTVKPTPQKTWYDNIVGSLDSPVFVADLRHDTPGSYHFGSIPSEASKAFYAPIDNSKGFWQFSTSSNISGQFNAVADTGTTLLLASDDLVKAYYAKVQGARVNVFLGGYVFNCTTQLPDFTFTVGEGNITVPGTLINYSEAGNGQCFGGIQPSGGLPFAIFGDIALKAAYVIFDSGNKQVGWAQKK

SEQ ID NO: 183 - protein, 401 aa, Trichoderma atroviride
MQPTTSFGTFLVTFLSASMAAGSAIPYMAPQPGSFEIKRAANNGFTGRNGALALARAYAKYGVPVTDTLLEAVETLKSAHLIKRSSGNVTATPDGDDLEYLVPVQIGTPPQTLNLDFDTGSSDLWVFSSETDTSSSQGHSVYSPSKSTSAQKLDGATWSITYGDQSSSSGDVYTDVVTLGSLTVKSQAVESAQQVSAQFAQGNNDGLLGLAFSSINTVKPTQQKTWFDNISGSLDSPLFVADLRHETPGSYIFGTIPSDASNVLYAPVDNSQGFWQFSTSSDIGGSFSAIADTGTTLLLASDDLVSAYYKNVQGAREDQQQGGYVFDCSTTLPDFTFTVGDGKITVPGSLINYGQASGSECFGGIQSSGGLPFAIFGDIALKAAYVVFDSGNTQVGWAQKK

SEQ ID NO: 184 - protein, 400 aa, Trichoderma virens
MQPVSFGSFLVTFLTASLAAGSALPNTVSSPGSFEIKRTPNKGFTGRNGPLALARAYVKYGVPVSKSLVEAIDLVKSAQLIKRSNGNVTATPDGDDLQYLVPVQIGTPPQTLHLDFDTGSSDLWVFSSETDPSSSKGHSLYNPSTSTSSKKVDGASWNITYGDQSSSSGDVYTDVVTVGSLTVNSQAVESAQQVSAQFAQGNNDGLVGLAFSSINTVKPTPQKTWFDNIASTLDAPLFVADLRHETPGSYIFGAIPSAASNILYAPVDNSKGFWQFSTSSDTGGEFDAIADTGTTLILASDALVKSYYQKVQGAHLDALQGGYVFGCNTTLPDFKFAVGEGEITVPGSLINYAPAGNNECFGGIQPSGGLPFAIFGDIALKAAHVVFDSGKTQVGWAQKK

SEQ ID NO: 185 - protein, 398 aa, Cordyceps militaris
MYKDVFPCSGFKSFGSFLVAALVAGFASGNPMPRASGSFELKQTANPNFSSRNGPQALANAYKKYGKAVPDHIAVAADKNTNAKRAAGTATANSIRGDLEYLVDVQIGAGQTLKLDFDTGSSDLWVFSTQTEGAGFQTKYDPSRSSSAKRLSGATWEISYGDGSNCSGDVYTDDVTVGGLTVKGQAVEAAQEVSQQFAQGQSDGLLGLAFSQLNTVTPQKQKTWFDNVKPQLDSPLFVADLKHNAPGSYIFGKIPSGAEQASYVDVDSSQGFWGFSATTMYGDVQAIADTGTTLLLLDNQSVQSYYANVQSAEYDQQEGGFVFNCGEQLPDFPFRVGGGIITIPGAIIKYAQGSDGRCFGGIQAAGNIPLNIFGDIALKAAYVIFDGGNNRLGWAQKN

SEQ ID NO: 186 - protein, 446 aa, Trichoderma reesei
MTLPVPLREHDLPFLKEKRKLPADDIPSGTYTLPIIHARRPKLASRAIEVQVENRSDVSYYAQLNIGTPPQTVYAQIDTGSFELWVNPNCSNVQSADQRFCRAIGFYDPSSSSTADVTSQSARLRYGIGSADVTYVHDTISLPGSGSGSKAMKAVQFGVADTSVDEFSGILGLGAGNGINTEYPNFVDELAAQGVTATKAFSLALGSKAEEEGVIIFGGVDTAKFHGELAHLPIVPADDSPDGVARYWVKMKSISLTPPPPSSSGSTDDNNNKPVAFPQTSMTVFLDSGSTLTLLPPALVRQIASALGSTQTDESGFFVVDCALASQDGTIDFEFDGVTIRVPYAEMIRQVSTLPPHCYLGMMGSTQFALLGDTFLRSAYAVFDLTSNVVHLAPYANCGTNVKSITSTSSLSNLVGTCNDPSKPSSSPSPSQTPSASPSSTATQKA

SEQ ID NO: 187 - protein, 608 aa, Trichoderma atroviride
MAIRSFLTLSLALLAHARPRHVFDPEDVGTKITLPVISAPRAVEAVAGRSAGDDEDKPFHILPFPYTGNGKRAILEDDDGAAGAVTLPVPRPASRRSAGDENEDEEDKPFHILPFNEKRKLPVEEGPIGTITLPVIHAARPVLDKRAVEVQVENRSDVSYYAQLNIGTPPQTVYAQIDTGSFELWVNPDCSNVASSDRRFCQAIGSYNPRSSSSAATTDESAMLRYGIGSANVSYFKDTIALSGAPAMKQVQFGVASASVDEFSGILGIGAGEGVNTDYPNFIDALAAQGVTKTKAFSLALGSKAEEEGVIIFGGVDTAKFQGKLATLPIVPAKESPDGVARYWVRMNSIALSPPQGKATTFSQTDMTVFLDSGSTLTLLPEQVVEEIATGLGSSGMDSTGYYAINCNLASQKGTIDFAFDGVTISVPYSEVIRQVSSSPPQCYLGMMGSTEFALLGDTFLRSAYAVFDLTGNSIHLAQYANCGTKVLTITPDSALQGLSSSCGGGSESPANPPASSSSSAAPAAPSKSAASKPSAPASSSVQPVHSPTPAASKPADQTPPATTTAASTPKSTPSSVSDAAGKSSAGRVNVQAVGWSMVSAAMGLLLL

SEQ ID NO: 188 - protein, 655 aa, Trichoderma virens
MGISSFLVLSLAVLAQARPRHAFEPEDVGDRITLPVISARAVDVKGDLSQRSAADEEDKPFHILPFPYPSKRDVESREEEDKPWHILPFPYPSKRDVESREEEDKPWHILPFPGPSKRKILEDDDGADGRITLPVPQRARRSEGEEDKPFHILPFNDKRKLPVEDVPSGTITLPIIHRHRSFLDKRAVEVQVENRSDVSYYAQLNIGTPPQTVYAQIDTGSFELWVNPDCSNVQTGDQRFCRAIGVYDPKSSSTSFVTGSAAQLRYGIGSANVSYVQDSISLPGSATMKQVQFGVALSSVDEFSGILGIGAGDGFNTLYPNFIDELASQGVTKTKAFSLALGSKAEEEGVIIFGGVDTGKFTGKLANLPIVPADDSPDGVARYWVGMNSISLSPPNGKSTTFAQTKMTVFLDSGSTLTLLPQSLVNEIADGLGSTGTDDSGFAIVDCDLANQPGTIDFAFDGVTIKVPYSEMIRSVNSLPPHCYLGMMGSTQFALLGDTFLRSAYAVFDLTGNMIHLAQYVNCGTNVKSITSTSSLLGLAGSCSSDGSESPSSPSSSSTSSSPSKTASKAAPSATAPSSSTVQPPSSAQSTAASPSAARSSDAASTTAANTAKSSATGGADAESAQSGDKNGAGKTGVHSLAISMVFAAMGLLLI

SEQ ID NO: 189 - protein, 545 aa, Glomerella graminicola
MTLPVIPYTTQDKTNVAPRGLSLPADEDAETSMMMTLPVTSHQRRKRRTRSPRKVLLDDILDSNLAPLPAAPVVKPPISMRGLPVVDGADANGAFVTLPVIHSTKRGVFSRQVEAKLANRSDVAYYAQLNIGTPPQAVYAQLDTGSFELWVNPDCNVLAASDQRFCEAVGFYDPARSTTSVQMQTTKTLRYGIGAANISYVRDSLALAGSSSTMRQVQFGVATSSEDQFAGILGIGAGEGVNTRYKNLIDELAAQGVTRTKAFSLGLGSKDEQEGAIIFGGIDTSKFSGPLARLPIIPADEAPDGVARYWVNMQSLSLTPPSRRTRLYANSSMPVFLDSGATLTLLPEELANMIAADFGSSGIDANGFYPVSCNLVGLNGTVDFDFDGMKIQVPYSEIIRELRTTPPTCYLGIVPNADFTLLGDTFLRSAYAVFDLDSNVAYLAQYTNCGTRTMPINQPQDIAAIRGLCPSPAGPGGSLPAANGTTNSPSSSSGSNRVPSTGSNVPGSPTPETSGVPAGTASAARATGRSMLATVSALLLAAMFW

SEQ ID NO: 190 - protein, 544 aa, Metarhizium acridum
MVSFLITTAVLSLSLSVHGWPQVRNESRFFGEEIRAENIVADISSRELPFVGEALSVGTLPVPQLSQRDDAVGSLEATEDDQDSSSNNSFQEDAKRGPPEGDISPGHLTLPVLHVERRLDKRDVEVRLENRSDVAYYVQPNLGTNPDPKKFKVNIGNPVQKVFAQLDTGSFELWVNPDCTSLPSSADKQFCQAVGQYNPLRSSSSKGSNLSTELRYGIGSAQITYFLDDIALVDSRQMKQVQFGVARSTKDQFSGILGIGHGVGVNTGYRNFVDQLADQGITKTKAYSVALGSKADRAGVVVMGGVDTAKFAGRLTPLPLIPGDKSPDGVTRFWVNLTSVQHNSESGRTANLTGATMPVFMDTGATLTLLPPRLANDIARRVGARGLDRNGLYMVDCGVAGKNGSLDFNFDGVTIRVPYSEMVREIATLPPSCYLGIMPSTSFTLLGDTFLRSAYVLFDISNNMTYMAPYANCGSKTQSIDSSTDLTSIVGTCSPQQVNELSKPVGGGSSDGNSGNKDNGAGLARMSWSWFGVLGAFAIGALTL

SEQ ID NO: 191 - protein, 506 aa, Thielavia terrestris
MAFSFLLLPTVLLIPLFCRHVTALQATALRQTAHDPGCVHLPVIHSTNVNYFSSKRAVQLQLANRSDVAYYAQLSIGTPPQPVFVQLDTGSFELWVNPDCTSITGADAAFCERTGQFDTKKSSTAISLGATKTLQYGIGSANITYFTDTITLAGSSAALQAVQFGVATASQDASSGILGIGYGKGIATNYPNFIDQLRAQNVTRVKAYTLALGSKDVEEGVIVFGGVDTSKFAGKLAKLPIIPAAQSPDGVPRFWVEMQSVSMTPPNGVSHVYNASSTPLFFDSGSTMTLLPPDLTNAIARDFGAQGPDANGFFRIDCALTTLNGTVDFAFDGVTIKVPYKELAREVASSPPVCFLGIMSSDRFTLLGDTFLRSAYAVFDLETNAIWLSQAENCGSSPAALNNIQDLAAVTGKCGVTEAADKDTSSTAVSSVAPESAEALPAPTASTVGLAATGTTSPGRTTPTAPTASTTPTTPSSSAGSCFRGQAGIVWVVGVMMLLHMLKLVL

SEQ ID NO: 192 - protein, 524 aa, Podospora anserina
MAFSLLLSASVLLLSSTFSGHAVASSLPFTNTTIPPTNVSIPHTHAPIKLINSSVIAHDDGCVHLPIVHSTNANHFSKKRGVQLQLANRSDIAYYAQLSIGTPPQPVFVQLDTGSFELWVNPDCTTVQGADAAFCQQVGRYDGNTSSTAKSLGTTKTLKYGIGTANITYFEDTITLAGTATALQAVQFGVATATEDTFSGILGIGYGKGIATKYKNFVDQLVAQNAIRAKAYTLALGSKEEKEGVIVFGGVDPSKFAGPLAKLPIIDANNSPDQVPRFWVDMNSIAITPPNNDTKVYEGSKMPVFLDSGSTMTLLPPDLAATIAKDFGADKEDDNGFYRIDCGLTSMNGTLDFSFNGLNIRVPYKEMIREVPSNPPACFLGITPSKKFTLLGDTFLRSAYVVFDLETNSIWMTQATSCGSTPAALGSVNDLSMVVGACGLTAEPAVTVSSAGGTTATPGVGVGGGGTGSDTNGASATVSTVVVPESPPGATSTAGSPVTSSSSRCHPMAVVAMAFALLALANMG

SEQ ID NO: 193 - protein, 496 aa, Chaetomium thermophilum
MAVPFLSSCLVLSTVWLSSLVTAQHLPHEKGCVHLPIVHSTNARLFGKRGVQLQLANRSDVAYYAQLSIGTPPQPVFVQLDTGSFELWVNPDCTTVEGADAVFCERVGQYDASKSSTAVSLGTSRTLRYGIGTANITYVTDTITLAGTGTTLQGVQFGVATATEDAFSGILGIGYGKGIATRYLNFVDQLKEQNATKVKAFSLSLGSKDAQEGVVVFGGVDTSKFAGHLTQVPIIPASQSPDGVPRFWVSMRSLAMTPPSGISKHYSGSEMPVFLDSGSTMTLLPPNLTEAIARDFGSKSEDAYGFHQIDCSLTKLNGTLDFYFDGVMIKVPYKELTREVPTNPPACFLGIMASDQFTLLGDTFLRSAYALFDLETDSIWMTQAANCGSTPAALNSVEDIQRITGLCDLSVPADNTTSSTEAFTPMTEVDQVSMTTVTSVTPIHTSTTATSPTEEVSIQSSATSISGANKLGRGNMEGILFWGPGVVIALHVLIGV

SEQ ID NO: 194 - protein, 479 aa, Verticillium dahliae
MTLPVPVTGGRGDQHDGEASRRQLPVDDDDDDTGAFYTLPIIHSTKRGVFSRQIEVELANRSDVAYYAQLNIGTPPQPVYAQLDTGSFELWVNPDCTVLRPADQRFCQAVGVYDPARSSSSSLLSSTASLRYGIGTANISYVRDDVSFAGSPVLSHVRFGMATATTDQFAGILGLGHGKNYTVTYPNMMDELVAQGAIRTKAYSLALGSKTEQQGLLVLGGIDTAKYSGHLAALPVIPAQQAPDRVARFWVNLRSLALTPPSGVTRAPYVAAAGLPVFLDSGATMTLLPRALADAIAADFGAPPSSSPDDPETSHTFYEVDCSMADAPGTLDFSFGRSLTIRVPYAEMVRRTRADPPRCVLGFVPDDDFALLGDTFLRSAYAVFDLESDVVYMAQYRNCGERPMAVRRVQDIHAIVGLCEAPARPSQAVAAPDTAPTEAATFASGPVPGLVDVSAAAGLSLSRAWVWSIAFAMVLVHVA

SEQ ID NO: 195 - protein, 489 aa, Myceliophthora thermophila
MAIPVLFSALVLLVALLCCHATAALQQLAHDVGCVHLPVVHSTKVDRFSDKRGIQLQLANRSDVAYYAQLSIGTPPQPVFVQLDTGSFELWVNPDCTTVSGSDAVFCERAGRYDVTKSSTATSLGTNRTLRYGIGAANISYFTDTISLAGSPMMLQDVQFGVATASEDAFSGILGIGYGKGIGTGYPNFVDQLWEQNVTRVKAYTLALGSKDSQEGVIVFGGVDTSKFAGKLARLPVIPPAQSPDGVPRFWVEMKSLSITRPSGLNTVYDGGAMPVFLDSGSTMTLLPANLTMAVARDFGAQAPDANGFYKIDCALTALNGTLDFAFDGVTVRVPYKELTREVASNPPSCFLGIVASDRFTLLGDTFLRSAYTVFDLETDSIWMAPAVNCGSSPAALSNVQDLSAVTGECGVREIAESTSSTQVPSTGVDDTEAGAVPTSTTTVVSQPSGTTTQMGARPTLDNASNPLGAHRLTWVLVITAALHLFTGI

SEQ ID NO: 196 - protein, 518 aa, Neurospora crassa
MAAFPFLSASFVLLQLALTCLAQHLNLTTGPLHLTGHTPGDGCVHLPIIHSTNTDHFARRGIQLALNNRSDVAYYAQLEIGTPPQTVYTQLDTGSFELWVNPDCTTVSPSDSSFCDHIGFYNASLSSTSKSLGTSKTLRYGIGAANISYVTDTISLSGSSTSLKDIQFGVATSSKDAFSGILGIGYGQGLATKYPNFIDQLYAQKITKVKAYTLALGSKTAQQGSIVFGGVDTSKFAGPLGRLPIIPAEDSPDGVPRFWVQMNGISLTPPSGQSMGVYEGSKIPAFLDSGSTMTILPPALANKIAEDFGSPEMDANGFYRVGCGYVEMNGTMDFEFVGAGQKVTVRVPYKEMIREVGQGESKMCFLGIMGSESFTLLGDTFLRSAYATSCGNTPAALRDVTDLSRVVGNCQIQLGEKEAVVDVVSETSIAPPTGSTGDTDGVTGTGGNGSGNGGTRTAWGFVTTTLAVPMATGLAGVGGSGSGSMSATALDSSGRSMAGDVVLSAAVAVGAAVLGSLL

SEQ ID NO: 197 - protein, 497 aa, Magnaporthe oryzae
MAATSIRGLLLLAVAAAAGPLEAAQEPHDPGCLHMPIMHMSKAEQYQKRAVKVPFDQRFDVGYYTKLSFGTPAQEALVHLDTGSFELWINPTCNNLDGAGEQQFCRAGGSYDPAQSTTVQRLGTTNTLRYGIGSANISYVKDTVGIPGTNMSVRSAQFGVATSSETQNAGILGIGHGVGQAIGYRNFIDELKAQNVTKTRAFSVALGGKDEKQGTVVFGGVDTSKFAGGLARLPIIPAAQSPDGVRRYWVNMSSISLHPPSGRNKTYPGTNMPVFLDTGSTLTLLPEALVKSVASDFGSMQQDAGGYWPVDCSLVGINGTMDFAFDGVTIKVPYKELIRQFGNSCVLGLSSHSSFTLLGDTFMRSAYFVFDQDSDCVWMTQYTNCGSTPAALASVASLRTLQGACPLKQGSVSAVTAGTAGAAAPSTTASPKAPGAGGGSGSNGGGGAKGSPPPGASASAPDSKLKNAGGRAMQVPAISSAVVTLVLTTLAALHLAL

SEQ ID NO: 198 - protein, 434 aa, Chaetomium globosum
MPQHSNKPSTTTVSLGTPPQPVFVQLDTGSFELWVNPDCTTVSGGDAVFCQRAGRYESTASSTATSLGTTRTLRYGIGAANISYFTDTISLAGSPMSLQDVQFGVATASVDAFSGILGIGYGKGIATRYPNFVDQLREQNATRVKAYTLALGSKDAQEGVIVFGGVDTSKFAGKLAKLPILPAAQAPDGVPRFWVDMQALSITPPNGVTTVYEGSSMPVFLDSGSTMTLLPANLTAAVARDFGAESPDSNGFYMIDCALTALNGTLDFVFDGVTVKVPYKELTREVASTPPSCFLGIMASDRFTLLGDTFLRSAYTVFDLETDSIWMTQATNCGSSPAALSNIQDLSVVVGECGAGASEDIDTTSSTQFPSTAVEDFESGAIPTSTGSFGPQVSEVAPPDQARPLPENSGPSLRAAGFIWNLGMAGAVHLLAGL

SEQ ID NO: 199 - protein, 467 aa, Magnaporthe oryzae
MKNTALLVATAAASVAAVGIAEIPREQVSTSSQPSTSDPGFVSFPIYHRSVSKPILKRNTDVTIYNISSVSYLIQLSIGTPGQQVKVAIDTGSDELWVNPNCTAVKSQDQRAECIADGQYNPGQSSTSQVSTTSNNIPYGKGDVNITYYKDSISMSNSSISLTNVIFGVATSSKDLNEGIMGLGYGDGVNLRYNNMVDSLFLQNVTKSRAFSVALGSAEASNSGVISFGGVDTKKFSGKLGQMPILGPQGKEEIRRYWVPMDSIAMSKNGGNKTYSGGNIPIVIDSGSTLSYLPSSVVTAMAMDANALWNSEGGVYFVKCDKMPADASFDFSFNNGSFRISVPWRNFFWNTGGNTCVLGAVPIKSGSVTALLGDSFMRSVYTVFDQTSNMVFMAPYANCGSNEQMIPASPSGAAANFTGECSPGQGLPDPTPQKNAAGKASGEPSKFEFWACAAVLVVGHLVFGMLL

SEQ ID NO: 200 - protein, 387 aa, Trichoderma reesei
MGLVTNPFAKNIIPNRYIVVYNNSFGEEAISAKQAQFAAKIAKRNLGKRGLFGNELSTAIHSFSMHTWRAMALDADDIMIKDIFDAEEVAYIEADTKVQHAALVAQTNAAPGLIRLSNKAVGGQNYIFDNSAGSNITAYVVDTGIRITHSEFEGRATFGANFVNDDTDENGHGSHVAGTIGGATFGVAKNVELVAVKVLDADGSGSNSGVLNGMQFVVNDVQAKKRSGKAVMNMSLGGSFSTAVNNAITALTNAGIVPVVAAGNENQDTANTSPGSAPQAITVGAIDATTDIRAGFSNFGTGVDIYAPGVDVLSVGIKSDIDTAVLSGTSMASPHVAGLAAYLMALEGVSNVDDVSNLIKNLAAKTGAAVKQNIAGTTSLIANNGNF

SEQ ID NO: 201 - protein, 445 aa, Trichoderma atroviride
MAPFNTMLGYLLLAVAPLAAALPFHGHGHNTNNHNLNLNFNLTETINEINENLAGLVGYITNPHAKNVIANRYIVVYNNTFGSEAIAAKQAEFAATIQKRNLGKRSLGGNLLSTEIHSFQMHNWRAMALDADDEMVKSIFSAQEVAYIEADAVVQTKGALVAQTNATPGLIRLSNRNAGGKNYIFDNTAGAGITAYVVDTGIRITHSEFEGRASFGANFVNSNNTDENGHGSHVSGTIGGATFGVAKNVKLVAVKVLDATGAGSNSGVLNGMQFVVNDVQAKGLSGKAVMNMSLGGSLSAAVNNAIAAIANAGVVPVVAAGNENQDTANTSPGSAPQAITVGAIDATNDVRASFSNFGPDVDIYAQGVNVLSVGIKSDTDTAVLSGTSMATPHVAGLAAYLMALKGLTNVDDVTTLIKNLATATGASVQQNVAGTTNLIANNGEL

SEQ ID NO: 202 - protein, 437 aa, Trichoderma virens
MAPFNTMLAYLLLVVAPLAAAVPFHNRHSLGGPQTHAHNTVNNINLAHLMNIVVNPTAKNIIPGRYIVVYNNTFGDEAISAKQAQFASTIAKRNLGKRNLVGNLLSTEIHSFKMHTWRAMALDADDDMIKNIFDAEEVAYIEADTKVQNTALVAQTNATPGLIRISNRNVGAANYIFDTSAGTGITAYVVDTGIRVTHTEFEGRATFGANFVNTNNTDENGHGSHVAGTIGGATFGVAKNVKLVAVKVLDASGSGSNSGVLNGMQFVVNDVQAKKLGGKAVMNMSLGGSFSTAVNNAITALANAGIVPVVAAGNENQDTANTSPGSAPQAITVGAIDATNDVRASFSNFGAGVDIYAPGVDVLSVGIKSDIDTAILSGTSMATPHVAGLAAYLMALQGVSNVNDVTNLIKNLAAKTGADVQQNVAGTTNLIANNGNL

SEQ ID NO: 203 - protein, 433 aa, Hypocrea lixii
MAPFNTMLAYLLMVVAPLAAAMPFHNRHSLSPQTHQHSALNMTHLMSVVINPHAKNIIPGRYIVVYNNTFGDAAISAKQAQFATAIAKRNLGKRDGLGNLLSTEIHSFQLHTWRAMALDADNDMIKSIFDAEEVAYIEADTKVQNTALVAQTNATPGLIRLSNKDVGGQNYIFDNSAASGMTAYVVDTGIRVTHTEFEGRATFGANFVNTNDTDENGHGSHVAGTIGGATFGVAKNIKLVAVKVLDASGSGSNSGVLNGMQFVINDVQTKKLAGKAVMNMSLGGSFSTAVNNAITALANAGIVPVVAAGNENQDTANTSPGSAPQAITVGAIDATNDVRASFSNFGAGVDIYAPGVNVLSVGIKSDIDTATLSGTSMATPHVAGLAAYLMALEGVTNVDDVSNLIKNLATKTGATVQQNVAGTTDLIANNANL

SEQ ID NO: 204 - protein, 442 aa, Fusarium oxysporum
MALLRTFLASLLVAAPFAAAAPIDVAETLGDMADSIGGGLGGEADKKMGISAFLRPMLKNPDALNVIPNRYIVVYNDTFDDDTISAKEASFAAAIKKRNLNKRSSIGKAMSTSIQSFRMNKWRAMSLDADDLMVQDLWNSDEVAYIEADTKVQLNAAIAQVNAPPGLDRLSHAKVNQDTYVFDDSAGEGITAYVVDTGIKIDHSEFEGRATFGANFINNVDDDENGHGSHVAGTIGGATFGVAKKVDLVAVKVLDASGGGSNSGVLQGMQFVIDDAKKKNRVGKAVMNMSLGGDFSQAINRAIEALFKAGIVPVVAAGNENRETALTSPGSAPNAITVGAIDATTDERADFSNFGPEVDVYAPGVNVLSVGIKSNTDTATLSGTSMASPHVAGLAAYLMGFQQLDGPAQVASLIKSLAGQTGAKVQNNVQGTTDSIANNGNQ

SEQ ID NO: 205 - protein, 446 aa, Gibberella zeae
MAFLKTFLASLLIAAPLATAAPVDVAQTIGNMAEAVGSDIGGGLGEELDKKMGISAFLRPMLSNPDSLNIIPNRYIVVYNDTFDDDAIAAKEFSIASAIKKRNLNKRSSIGQAMSTSIKSFRMNTWRAMSLDADDMMVQDLFKSDEVAYIEADTRVQLNAAIAQVNAPPGLNRLSHAQADQENYIFDDSAGEGITAYVVDTGIKVDHSEFEGRATFGGNFIDNVDDDENGHGSHVAGTIGGATFGVAKKVDLVAVKVLDASGGGSNSGVLQGMQFVVDDVKKNNRAGKAVMNMSLGGDKSEAINRAIEALFKAGVVPVVAAGNENRETALTSPGSAPNAITVGAIDATSDQRADFSNFGPEVDIYAPGVDVLSVGIKSNTDTATLSGTSMASPHVAGLAAYLMGFQKLDGPAQVASLIKSLAAESGAKVRNNVRGTTDGIANNGNQ

SEQ ID NO: 206 - protein, 423 aa, Glomerella graminicola
MVRPIAILAAVLPAVLAAPFGLNENKAANNTDTFMGVPISNLNALDLIPNKYIVVYNNSFDDDAITSKMSSFAAAIKKRNIGKRSLDGRSLSTSTRNFKMNNWRATVMEADDNMIMNVMSAEEVAYVEQDAKVKISATVSQTNAPPGLVRLSHAAAGETGYVFDQVSGDGITAYVVDTGILTTHSEFQGRATFGANFINNVDTDENGHGSHVAGTIGGQTFGVAKNVKLVAVKVLDGDGAGSNSGVLDGMQFVIDDVKAKNITGKAVMNMSLGGSASAAVNRAIEALNTAGIVPVVAAGNENQDAANTSPASAPNAITVGAIDARNDRKASFSNFGKVVDIFAPGVNILSVGIASNTATNTLSGTSMASPHVAGLAAYLMGLEGLNTVKSLTDRMLQLATASGASVQRNTAGTTNLIANNGQL

SEQ ID NO: 207 - protein, 387 aa, Nectria haematococca
MVSNPEAQNIIPNKYIVVFNNDDFDDDAISAKEASFAMAIKKRNLNKRGLNGLNLSTTINSFKMNKWRAMSLDADDLMIKDLYDADEVAYIEADTHVQLNGAIAQVNAPPGLDRLSHAQPNEDTYVFDDSAGEGIVAYVVDTGIKTTHTEFEGRATFGGNFINNVDDDENGHGSHVAGTIAGATFGVAKKAELVAVKVLDVSGGGSNSGVLQGMQFVIDDVEKRGKKGKAVMNMSLGGDFSEAINRAIEALFKAGIVPVVAAGNENVNTALTSPGSAPNAITVGAIDGTTDVRAPFSNFGPDVDIYAPGVQVLSVGIDSNTATASLSGTSMASPHVAGLAAYLMAFQNVQEPSRVVELIKSLAQQSGAKVRNNAADTTDLIANNGNQ

SEQ ID NO: 208 - protein, 425 aa, Cordyceps militaris
MTQLHYRFTSLLLLLGLAIAAPGRIANPPESTAFRLPVSNANVAVTNMIPNRYIVVYNKDFNSTSIDAKEASFAAALRKRNLGKRGLGGNPLSTEVNSLSMNKWRASILDADDDMFMEMYNSEEVSYIEADTRVHTQVVISQINAPPGLARLSHATNGPSNYLFDESAGQGVTVYIVDTGILPSHVEFEGRARSAANFVNQVDTDENGHGSHVAGTIGGATYGVAKRCELLGVKVLDASGGGANSGVLKGLQFVMNDVAERNVSKAVMNMSLGGPRSRAINTAISQLAQAGVIPVVAAGNEDQDASTTSPASAPDAITVGAIDVRNDAKASFSNFGSSVAIFAPGVNILSVGIASNTDSKVLSGTSMASPHVAGLAAYLMGLRGLDEQQPSQVEDLMKNLAGQTGARVRGNEQGTTNRIANNGSR

SEQ ID NO: 209 - protein, 433 aa, Neurospora crassa
MVRFSVAAAFLLSALGVTAAPSGGRHNHQNTQNTGATAGNAAGVPVANSDISNIIPGRYIVVYNNTFGEEAINAHQIKVTSLVAKRNLGKRDAKTGRIMSPSVKAFKMGTWRAMALDADDDMINDINSAQEVEYIEADQYVKLNALTSQNSTTTGLARLSHAGPSKKAAPYIFDSSAGEGITAFVVDTGIRVTHSEYEGRATFAANFVNNVDTDENGHGSHVAGTIAGATFGVAKKAKLVAVKVLDGSGSGSNSGVLQGMQFVADTATSQKLGGKAVLNMSLGGGKSRAINSAINQIAAAGVVPVVAAGNENQDTANTSPGSAPAAITVGAIDQRTDARASFSNFGAGVDIFAPGVNVLSVGIKSDTDTDTLSGTSMASPHVAGLAAYLMALEGLTDVTAVGNRIKELAQKTGAKVTNNVRGTTSLIANNGNL

SEQ ID NO: 210 - protein, 433 aa, Neurospora tetrasperma
MVRFSVAAAFLLSALGVTAAPSGGRHNHQNTQNTGATAGNAAGVPVSNSDISNIIPGRYIVVYNNTFGEEAISAHQIKVTSLVAKRNLGKRDAKTGRIMSPSVKAFKMGTWRAMALDADDDMINDINSAQEVEYIEADQYVKLNALTSQNSTTTGLARLSHAGPSKQAAPYIFDSSAGEGITAFVVDTGIRVTHSEYEGRATFAANFVNNVDTDENGHGSHVAGTIAGATFGVAKKAKLVAVKVLDGSGSGSNSGVLQGMQFVADTATSQKLGGKAVLNMSLGGGKSRAINSAINQIAAAGVVPVVAAGNENQDTANTSPGSAPAAITVGAIDQRTDARASFSNFGAGVDIFAPGVNVLSVGITSDTATDTLSGTSMASPHVAGLAAYLMALEGLTDVTAVGNRIKELAQKTGAKVTNNVRGTTSLIANNGNL

SEQ ID NO: 211 - protein, 411 aa, Verticillium dahliae
MAPISKEVPAGAITGAADFFAKGFSAMLNSESTERVSNSYIVVYNNTFDDDTINFRQTEVMNHIKRRNIGKRGLDGRQLSTEVHALAMNGWRAMTLESDDDMILQIMNEPEVAWVEANARVKLSASVAQMNAPPGLNRLSNAQAGTGNYVFDTTGGEGVTVYVVDTGIRTDHSEFQGRATFGVNTVDNVDNDQNGHGSHVAGTICGQTFGVAKSANVVAVKVLDGTGAGSNAGVLDGLQFIINDVQQKNLRGKAVMNMSLGGPQSAAVNRAVQALFDAGVVPVVAAGNENQDAANTSPASAPKAITVGAIDASNDQKASFSNFGADVDIFAPGVDVLSVGIRSNTATDTLSGTSMASPHVAGLAAYLIALENINTPEAVASRLTELATASGAQVLRNTPGTTNLIANNGQL

SEQ ID NO: 212 - protein, 424 aa, Thielavia terrestris
MAGRLLAALTFALAALGASGLPQPSKAEGFFLGVPISNPEAKNAIPHKYIVVYNSTFSDAEIQAHQDSIIKTISKRNVGKRSPLTGKVLSPHVSTFSMGTWRAMALEADDLMMNEIFAAKEVDYIEQDAYVSIAAQQVQSQATSGLARISHAKPGATTYVFDSSAGQGMTAYVVDTGILVTHSEFEGRATFAANFVGDNQDTDLNGHGSHVAGTIGGKTFGVAKKVNLVAVKVLDANGSGTNSGVIAGMQFVAQNATGSGLSGKAVMNMSVGGSFSRAVNSAINQVAAAGVVPVVAAGNENQNAANTSPASATAAITVGAIDQTDDTRASFSNFGRVVDVFAPGVNVLSVGIRSNTDTQVLSGTSMATPHVAGLAAYLMALEGITGGAQAVSDRIKQLAQATGATVGNDVRGTTTLIANNGNRN

SEQ ID NO: 213 - protein, 511 aa, Magnaporthe oryzae
MAPISSILAPFAALAGLVAALPSNFPGSEKFAGVPVSNINALNVIPQSYIVVYNSTFDSKIIDDSQAMAMAKVAERNLGKRSEDGRDMSTTATTCQIGTWRGLMLDADDQTIMEIMADPAVRYVEADAAMNILIDEEASEMPPPAEITEMQAIARRAEQTETGAPNGLARLSQSEPNPGTSGTYRFEDSAGEGITVYIVDTGIRATHTEFEDRATFGANFIDQVDTDQNGHGSHCAGTIGGKTFGVAKKATLVGVKVLGASGGGSNRGVIQGMQFVANDVTQKNLARKAVMNMSLGGSKSTAVNEAINSMIKAGVVAVVAAGNENDDASKSSPASAPGAITVGAIDQKNDRKASFSNFGTDVDIFAPGVNVLSVDAKSDTGSKTLSGTSMASPHVAGLAAYLMALDPTLTAGGGIETVAGKVDARIKELAKAMGAQVGQAPAGTTTLIANNGKTGNGAGNGTAAAAPADNADAAPATGATRRLRKAQRLTFQRMQQFQRQQIQRQQSQRQQ

SEQ ID NO: 214 - protein, 409 aa, Trichoderma reesei
MASLRRLALYLGALLPAVLAAPAVNYKLPEAVPNKFIVTLKDGASVDTDSHLTWVKDLHRRSLGKRSTAGVEKTYNIDSWNAYAGEFDEETVKQIKANPDVASVEPDYIMWLSDIVEDKRALTTQTGAPWGLGTVSHRTPGSTSYIYDTSAGSGTFAYVVDSGINIAHQQFGGRASLGYNAAGGDHVDTLGHGTHVSGTIGGSTYGVAKQASLISVKVFQGNSASTSVILDGYNWAVNDIVSRNRASKSAINMSLGGPASSTWATAINAAFNKGVLTIVAAGNGDALGNPQPVSSTSPANVPNAITVAALDINWRTASFTNYGAGVDVFAPGVNILSSWIGSNTATNTISGTSMATPHVVGLALYLQALEGLSTPTAVTNRIKALATTGRVTGSLNGSPNTLIFNGNSA

SEQ ID NO: 215 - protein, 409 aa, Trichoderma atroviride
MTSIRRLALYLGALLPAVLAAPAALHKKPEAVPNKFIVTLKEGASIDTDSHLAWVTDIHTRSLTKRSTAGVEKTYNIHTWNAYAGEFDEETIEQIKSNPDVASVEPDYIMHLSDIVEDKRALTTQSGAPWGLGTVSHRTSGSTSYIYDSSAGAGTFAYVVDSGINTSHQQFGGRASLGYNAAGGQHVDTLGHGTHVSGTIGGSTYGVAKQASLISVKVFAGESASTSVILDGYNWAVNDIVSKSRASKSAINMSLGGPASSTWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLTSPTAVTNRIKALATSGRVTGSLNGSPNVIIFNGNSS

SEQ ID NO: 216 - protein, 409 aa, Trichoderma virens
MASIRRLALYLGALLPAVLAAPAGHHKAPEAVPNKFIVTLKEGASIDTDSHLTWVNDLHRRSLTKRNTAGVEKTYNIHTWSAYAGEFDEDTIEQIKASPDVASVEPDYIMYLSDIVEDKRALTTQTGAPWGLGTVSHRTSGSTSYIYDTSAGSGTFAYVVDSGINTSHQQFGGRASLGYNAAGGQHVDTLGHGTHVSGTIGGSTYGVAKQASLISVKVFQGNSASTSVILDGYNWAVNDIVSRNRASKSAINMSLGGPASSAWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLATPTAVTNRIKALATSGRVTGSLNGSPNVLIFNGNSA

SEQ ID NO: 217 - protein, 409 aa, Trichoderma virens
MASIRRLALYLGALLPAVLAAPAGHHKAPEAVPNKFIVTLKEGASIDTDSHLTWVNDLHRRSLTKRNTAGVEKTYNIHTWSAYAGEFDEDTIEQIKASPDVASVEPDYIMYLSDIVEDKRALTTQTGAPWGLGTVSHRTSGSTSYIYDTSAGSGTFAYVVDSGINTSHQQFGGRASLGYNAAGGQHVDTLGHGTHVSGTIGGSTYGVAKQASLISVKVFQGNSASTSVILDGYNWAVNDIVSRNRASKSAINMSLGGPASSAWTTAINAAFNQGVLTIVAAGNGDSLGNPQPVSGTSPANVPNAITVAALDINWRTASFTNYGAGVDVFAPGVNILSSWIGSNTATNTISGTSMATPHVVGLALYLQSLEGLATPTAVTNSPNRIKALATSGRVTGSLNGVLIFNGNSA

SEQ ID NO: 218 - protein, 409 aa, Hypocrea lixii
MASIRRLALYLGALLPAVLAAPAAHHKAPEAVPNKFIVTLKEGASVDTDSHLTWVNDLHRRSLTKRNTAGVEKTYNIHTWNAYAGEFDEETIEQIKSSPDVASVEPDYIMYLSDIVEDKRALTTQTGAPWGLGTVSHRTSGSTSYIYDTSAGSGTYAYVVDSGINTSHQQFGGRATLGYNAAGGQHVDTLGHGTHVSGTIGGSTYGVAKQANLVSVKVFQGDSASTSVILDGYNWAVNDIVSKNRASKSAINMSLGGPASSTWTTAINAAYNQGVLTIVAAGNGDSFGNPQPVSGTSPANVPNAITVAALDINWRTASFTNYGAGVDVFAPGVNILSSWIGSNTATNTISGTSMATPHVVGLALYLQSLEGLSTPAAVTNRIKALATSGRVTGSLNGSPNVIIFNGNSA

SEQ ID NO: 219 - protein, 409 aa, Trichoderma hamatum
MTSIRRLALYLGALLPAVLAAPAALHKKPEAAPNKFIVTLKEGASIDTDSHLAWVNDIHRRSLTKRSTAGVEKTYNIHTWSAYAGEFDAETIEQIKSSPDVASVEPDYIMYLSDIVEDKRALTTQSGAPWGLGTVSHRTSGSTSYIYDSSAGSGTFAYVVDSGINTSHQQFGGRASLGYNAAGGQHVDTLGHGTHVSGTIGGSTYGVAKQASLISVKVFAGESATTSVILDGYNWAVNDIVSRNRASKSAINMSLGGPASSTWTTAINAAFNQGVLTIVAAGNGDSFGNPQPVSGTSPANVPNAITVAALDINWRTASFTNYGAGVDVFAPGVNILSSWIGSNTATNTISGTSMATPHVVGLALYLQSLEGLTTPTAVTNRIKALATAGRITGSLNGSPNTLIFNGNSA

SEQ ID NO: 220 - protein, 403 aa, Aspergillus fumigatus
MLSIKRTLLLLGAVLPAVFGAPVQETRRAAQKIPGKYIVTFKPGTDTATIESHTLWATDLHKRNLERRDTTSGEPPVGIEKSYKIKDFAAYAGSFDDATIEEIRKRGDVAHVEEDQIWYLDALTTQKGAPWGLGSISHKGQASTDYIYDTSAGAGTYAYVVDSGINVNHVEFESRASLAYNAAGGSHVDSIGHGTHVAGTIGGKTYGVAKKTNLLSVKVFQGESSSTSIILDGFNWAVNDIVSKGRTKKAAINMSLGGGYSYAFNNAVENAFDEGVLSVVAAGNENSDASNTSPASAPNALTVAAINKSNARASFSNYGSVVDIFAPGQDILSAWIGSTTATNTISGTSMATPHIVGLSVYLMGLENLSGPAAVTARIKELATNGVVTNVKGSPNKLAYNGNA

SEQ ID NO: 221 - protein, 403 aa, Aspergillus terreus
MQSIKRTLLLLGAVLPAVLAGPIFPHRRAPTTIPGKYIVTFKSDVDQAAIDKHTAWATDIHKRNLQRRDSSEEDLPIGIERNFKINKFAAYSGSFDEDTIAQIRQSDEVAAVEEDQVWHLFDLTTQSDAPWGLGSISHKGQPSTDYIYDTNGGEGTYAYVVDTGINVDHEEFEGRASLAYNAAGGQHVDGVGHGTHVSGTIGGKTYGVAKKANLLSVKVFVGESSSTSIILDGFNWAANDIVSKKRTGKAAINMSLGGGYSKAFNDAVENAFNEGVLSIVAAGNENTDASSTSPASAPDAFTVAAINVNNTRAYFSNYGSVVDIFAPGQNILSAWIGSNTATNTISGTSMATPHIVGLSIYLMSLEDLSSPKAVSDRIKELATRGVVSNVAGSPNLLAYNGNA

SEQ ID NO: 222 - protein, 403 aa, Aspergillus oryzae
MQSIKRTLLLLGAILPAVLGAPVQETRRAAEKLPGKYIVTFKPGIDEAKIQEHTTWATNIHQRSLERRGATGGDLPVGIERNYKINKFAAYAGSFDDATIEEIRKNEDVAYVEEDQIYYLDGLTTQKSAPWGLGSISHKGQQSTDYIYDTSAGEGTYAYVVDSGVNVDHEEFEGRASKAYNAAGGQHVDSIGHGTHVSGTIAGKTYGIAKKASILSVKVFQGESSSTSVILDGFNWAANDIVSKKRTSKAAINMSLGGGYSKAFNDAVENAFEQGVLSVVAAGNENSDAGQTSPASAPDAITVAAIQKSNNRASFSNFGKVVDVFAPGQDILSAWIGSSSATNTISGTSMATPHIVGLSLYLAALENLDGPAAVTKRIKELATKDVVKDVKGSPNLLAYNGNA

SEQ ID NO: 223 - protein, 416 aa, Aspergillus niger
MAFLKRILPLLALILPAVFSATEQVPHPTIQTIPGKYIVTFKSGIDNAKIESHAAWVTELHRRSLEGRSTTEDDLPAGIERTYRIANFAGYAGSFDEKTIEEIRKHNHVAYVEQDQVWYLDTLVTERRAPWGLGSISHRGASSTDYIYDDSAGEGTYAYVVDTGILATHNEFGGRASLAYNAAGGEHVDGVGHGTHVAGTIGGKTYGVSKNAHLLSVKVFVGESSSTSVILDGFNWAANDIVSKNRTSKAAINMSLGGGYSYAFNNAVENAFDEGVLSCVAAGNENRDAARTSPASAPDAITVAAINRSNARASFSNYGSVVDIFAPGEQVLSAWTGSNSATNTISGTSMATPHVTGLILYLMGLRDLATPAAATTELKRLATRNAVTNVAGSPNLLAYNGNSGVSKGGSDDGDED

SEQ ID NO: 224 - protein, 411 aa, Glomerella graminicola
MANLRRLALAIAALLPAVLAAPAALNRRDEPAAAPGKYIITLKEDAAVNVDSHLNWVADVHRRSLGKRNTAGVENKFNISTWNAYSGEFDEATIEAIKASPEVAVVEPDYYMYLSDFEVDERALTTQTGAPWGLGSISHKTKGSTQYVYDTSAGANTYAYVVDSGVISTHTQFGGRVTLGFNAYSGVHTDTLGHGTHVAGTIGGSTYGVAKQTNIISVKVFQGASGTTSSILSGFNWAVNDITSKGRAARSVINMSLGGPSSTTWNTAINAAYSQGVLSVVAAGNGDSLGNPLPVSSQSPANVPNALTVAAIDSNWAPAYFTNYGPGVDIFAPGVSILSAWIGGNSATNTISGTSMATPHVTGLALYLQALENIATPAALTARIKALGTSGRITGTLSGSPNLVAYNGNGA

SEQ ID NO: 225 - protein, 411 aa, Gibberella zeae
MTSFRRLALALGALLPAVLAAPTEKRQELTAAPDKYIITLKPEATENKIEAHLNWVSDVHRRSLNKRDTSGVEKKFNISSWNAYSGEFDKATIDEIKKSPEVAFVEPDYTVYLDFETELTDRALTTQSGAPWGLASISRRTSGGSTYTYDTTAGSGSYGYVVDSGINVNHRDFGGRASLGYNAAGGAHVDTLGHGTHVAGTIASSTYGVAKAANVISVKVFTGNSASTSTILAGFNWAVNDITSKGRAGRSVINMSLGGPSAQTWTTAINAAYNSGVLSVVAAGNGDDLGRPLPVSGQSPANVPNALTVAAIDSSWRTASFTNYGAGVDVFAPGVGILSTWYTSNTATNSISGTSMACPHVAGLALYLQVLEGLSTPAAVTNRIKALATTGRVTGTLNGSPNLIAFNGAST

SEQ ID NO: 226 - protein, 414 aa, Fusarium oxysporum
MTSIRRLALALGALLPAVLAAPADILSKRQAVPDKYIITLKPDASDSSVAAHLNWVGDVHRRSLNKRDTSGVEKTFNISSWSAYSGEFDKSTIAEIKKSPEVAFVEPDYTMYLSYEESEPELADRALTTQSGAPWGLGTISHRTSGSTSYIYDTTAGQGSYAYVVDSGVQVSHTNFGGRASLGYNAVGGAHEDTLGHGTHVAGTIAGTTYGVAKRANIISVKVFAGREGSTSTILAGFNWAVNDITSKSRAGRSVINLSLGGPASQTWTSAINAAYNSGVLSVVAAGNGDDAGRPLPVSGQSPANAPNALTVAAIDSSWRPASFTNYGAGVDVFGPGVNILSTWIGSNSATNTISGTSMACPHVAGLALYLQVLEGLSTPASVTNRIKSLATTGRITGTLSGSPNSVAYNGNGA

SEQ ID NO: 227 - protein, 415 aa, Nectria haematococca
MASIRRLALFLGALLPAALAAPVDGPVRRQETAIPNKYIITLKPEASDSKISAHLDWVGDVHRRSLSKRDTAGVEETYNISNWNAYAGEFDEATIEEIKSSPEVAFVEPDFEAYLWVEESSELSDRALTTQTGATWGLGTISHRTSGSTSYIYDTSAGSGSYAYVVDSGVQVGHSQFGTRASLGFNAFSGAHTDTLGHGTHVAGTIAGSTYGVAKQANIISVKVFQGNQGSTSTILSGFNWAVNDITSKGRQGRSVINLSLGGESSQTWISAINAAYNSGVLSVVAAGNGDINGNPLPVSSQSPANAPNALTVGAIDSSWRPASFTNYGAGVDIHAPGVSVLSSYIGSNTATRSLSGTSMACPHVAGLALYLQVLEGLSTPAAVTNRIKALGTSGRITGTLNGSPNLVAYNGNGA

SEQ ID NO: 228 - protein, 403 aa, Neosartorya fischeri
MLSIKRTLLLLGAVLPAVFGAPVQETRRAAQKIPGKYIVTFKPGTDAATIESHTLWATDLHKRNLERRDATSGEPPIGIEKNYKIKDFAAYAGSFDDTTIEEIRKSADVAHVEEDQIWYIDALTTQKGAPWGLGSISHKGQASTDYIYDTSAGAGTYAYVVDTGINVNHVEFEGRASLAYNAAGGSHVDSVGHGTHVAGTIGGKTYGVAKKTNLLSVKVFQGESSSTSIILDGFNWAANDIVSKGRTRKAAINMSLGGGYSYAFNNAVENAFDEGVLSVVAAGNENTDASNTSPASAPNALTVAAINRSNARASFSNYGSVVDIFAPGQDILSAWIGSNTATNTISGTSMATPHIVGLSVYLMGLESLSGPAAVTSRIKQLATNGVVTNAQGSPNKLAYNGNA

SEQ ID NO: 229 - protein, 393 aa, Verticillium albo-atrum
MVNFRNVLLGLLPFAAAAPVAPGSPDVANKYIVTLKSGISTDNVASHLNWVSDVHKRSLGRRDLAGVEKTYDIKNFHAYAGTFDESVVAELKNNPDVAAVEPDQIYTLSAYTTQSSAPWGLASISSRTSGATSYRYDNSAGAGTFAYVVDSGILTTHTNFGGRAIRGYNAAGGEWVDSIGHGTHVAGTIGSTTYGVAKAATLIDVKVFVGRTSSTSIILDGFNWAVNDIVSKNRASRSVINLSLGGPTSTAWTSAINAAYSSGILSVAAAGNENVSASTRSPANAPNALTVGAINSAWAEDTSYSNFGPAIDILAPGTNVLSLGYTSNTSTRTLTGTSMAAPHVAGLALYLAAFENINTPAALRNRIVALGTSGRATGIRGGSPNLIAYNGNA

SEQ ID NO: 230 - protein, 401 aa, Glomerella graminicola
MVGFKRFAMLAAAACAMAAPTRREEATEVTAQTIEGSYIITLKNTVSVEGLTSHLSWINDVHSRSLDKRQFPGAERTFSFNSFQAYSGKFDDATIDIIKSSPEVASVERDQLWTLSAIATQTGAPWGLGTVSRRTSGSTQYLYDTNAGSGTFAYVVDSGINVGHTNFGGRATLGYNAAGGAHTDTLGHGTHVAGTIGSTTYGVAKLTSLISVKVFVGNSASTSVILAGYNWAVNDITTKGRASKSVINMSLGGPSSTAWTTAINAAYSAGVITVVAAGNEAQNAANVSPANAPNAITVGAITSTWAIASYSNYGTSLDLFAPGSSILSTWIGSTTATNSISGTSMASPHVAGLVNYLQSVENVGTPAAVVARIKALATTGRVTGNLRSSPNLIAYNGAGGA

SEQ ID NO: 231 - protein, 555 aa, Trichoderma reesei
MRACLLFLGITALATAIPALKPPHGSPDRAHTTQLAKVSIALQPECRELLEQALHHLSDPSSPRYGRYLGREEAKALLRPRREATAAVKRWLARAGVPAHDVLTDGQFIHVRTLAEKAQALLGFEYNSTLGSQTIAISTLPGKIRKHVMTVQYVPLWTEADWEECKTIITPSCLKRLYHVDSYRAKYESSSLFGIVGFSGQAAQHDELDKFLHDFAPYSTNANFSIESVNGGQSPQGMNEPASEANGDVQYAVAMGYHVPVRYYAVGGENHDIIPDLDLVDTTEEYLEPFLEFASHLLDLDDDELPRVVSISYGANEQLFPRSYAHQVCDMFGQLGARGVSIVVAAGDLGPGVSCQSNDGSARPKFIPSFPATCPYVTSVGSTRGIMPEVAASFSSGGFSDYFARPAWQDRAVGAYLGAHGEEWEGFYNPAGRGFPDVAAQGVNFRFRAHGNESLSSGTSLSSPVFAALIALLNDHRSKSGMPPMGFLNPWIYTVGSHAFTDIIEARSEGCPGQSVEYLASPYIPNAGWSAVPGWDPVTGWGTPLFDRMLNLSLV

SEQ ID NO: 232 - protein, 561 aa, Trichoderma atroviride
MKASRLLFFGVNATVTASPIQQLGESSKAAQVVKLSIALQPESRQLLEQTIYNLSSPSGSRYGQYLGREEAKGLLRPRKSSTDAVKGWLSQAGIRSGHILSDGQFIHVQTDVGSIEALFEVNYNATLGSQTVSVSSLPLRIQGHVMTVQYAPYLTRVRTDWERCKTEITPACLKKLYHVDSYQAKGEERNLVGVAGFDGQAIQYHELGEFLHELVPPPAAFNVSVAFVNGGTNPQGTNFPSSEANQDVQYAVGMAHSVPVRFYATGGENHDIIPDLDLTDPTNEYLEPYLEFANHLLNLPDEQLPSVISISYGANEQLFPKPYAQQVCDMFGQLGTRGVSIIVSSGDFGPGMSCQSNDGTETTKYIPSFPATCPYVTSVGSTEGIGPERAANFSAGGFSDYFARPEWQDEAVGGYLELYGNEWKGYYNAGGRGFPDVAAQGVNYRFWNHGKEDLTTGTSVSTPVFAALVALLNDHRAERGLPRMGFLNPWIYSIGNGAFTDITQSKSIGCQGQSLSGLASPVIPNAGWSAVKGWDPVTGWGTPLFDKMMSLSGGGVDEESH

SEQ ID NO: 233 - protein, 556 aa, Trichoderma virens
MKARLLFLAFNALAMATPMAKPPLGTLKGVQPIQSGKISIALQPECRELLEQTLHYLSDPSSRRYGQYLGREEAKALLRPRQDSTDAVKGWLSQAGIPAIDIQSDGQFINVQVMAEQARALLGTGYNSTLGIQTIPISSLPKDIESHVMTIHYAPTRTEMVTDWEECKSRITPNCLKKLYHVDGYRARHVNKNRFGIVGFTGQAAQYDQLSAFLDDFAPYAANANFSVESVNGGENPQGRNEPTGEANVDIQYAVSMAYDVPVRFYATGGANHDIIPDLDLSDTDNQALEPYLEFASHLLSLDDDELPKVVSISYGANEQLFPRSYAQQVCDMFGQLGTRGVSIVVASGNLGPGVSCQSNDGTKRPKFMPSFPATCPYVTSVGATYGINPEIAVNFSSGGFSDYFIRPQWQDEAIEGYLKLHGREWKGYYNPHGRGFPDVAAQGVNYRFWSHGNEDSASGTSVSSPVFAALIALLNDNRTKNGLPSMGFLNPWIYSIGSHAFTDITESKSLGCSGRSVIGLESPVIPNAGWDAVPGWDPVTGWGTPLFDRLMNLSY

SEQ ID NO: 234 - protein, 592 aa, Metarhizium anisopliae
MSILGLLCVLGSIFLVVSADLVVVEHLDQPPDGWTKLGAANASQLIRLSIALESQGHDVFERTLQEVSDPTHPRYGQYLSRDEAVALVRPRPRSVAAVREWLLSENVTQGQVQERGLFVDAFMTIGTAENLLSTTYGLFRHGKQRAIGALAYSVPAEVRPHITSIQPTTFFEFGNLFKKSPRTSGVGIATARRRNPGVRARSTELQDCENHNTPECLRGLYKMSNDYTKPHRSSLLGVAGFHGQAAQHDQLEKYLDTYAPYAKGANFSVELINNGTNPQGEYPGFEANMDIQIAVSMAFRVPVRFYSTGGEGHEFIPDLDVYDPEKQHLEPWLQFASYLLDLPDRDLPQVMSISYGGNEQAVPKPYARRICQMFGLLALRGVSIILASGDQGPGMSCQSNDGTNSTKFLPAFPAGCPYLTVVGATERNAPERAMNFSSGGFSEYWPRPAWQEAAVSRYLDAHGDRWKGYYNRAGRGFPDVSAQGIGYPFFNHGGNASGGGTSASAPLFASMIAVINDSRMKRGKPPLGFLNPWLYLGASRAFTESEGCKGTSFSGAKAPVIPGAGWDAVEGWDPVTGLGTPLFDELQELAMG

SEQ ID NO: 235 - protein, 603 aa, Nectria haematococca
MMAISLLKTWGFLLLTATAVARPVVVESLDETPEGWEESSSPAPDKPIEFSIGLESEDHFLLERTLSEISDPSHANYGKHLSRDAAKALLHPSRAATDSVKRWLSDAGVPEHHVRDEGQWLHIRTTVGQADSLLSTRFGIFARDDEQVVRTREYSVPIEVRDHITTIQPTTFFPTEKKARAVEDLTALEKREEAVEARAYGNNNDGNHGGNGPIDLQQCKAQLTPACLRKIYKMPLRSYPSAHRKSEYGIVGFLEQNAQFSDLEEFLKRFAPDLKGANFSVSLVNGGLNQQSFNVAQIEANMDIQYAVALADKVPVRFISVGGMNPNLVPDLEQYPEPWLELLQYLLNLPNSNLPKVISLSYGSNEQHISKSYARQVCNMFGQLGTRGVSVIAAAGNTGPGFSCKPNDGKNKKKFLPTFPGACPYVTSVGGTEGNSPEIAWNRSSGGFSEVFSRPWWQEQTVKEYLRKHGNEWKGYYNANGRAYPDVAALAWNHQIMLRGNQTFGGGTSVAAPTFGAMIALINNERFKKGKPPMGFLNPWLYKTGKAGFTDITQGKSVGCTGESYLGLPSPVIPSAGWKAVKGWDPITGWGTPLFDRLQRLAT

SEQ ID NO: 236 - protein, 621 aa, Myceliophthora thermophila
MLRNIFLTAALAAFGQCGSTVFESVPAKPRGWTRLGDASADQPLRLRIALQQPNEDLFERTLYEVSDPSHARYGQHLSRDELSALLAPRAESTAAVLNWLRDAGIPSDKIEEDGEWINLRVTVREASELLDADFGVWAYEGTNVKRVRALQYSVPEEIAPHIRMVAPVVRFGQIRPERSQVFEVVETAPSQVKVAAAIPPQDLDVKACNTSITPECLRALYKVGSYQAEPSKKSLFGVAGYLEQWAKYDQLELFASTYAPYAADANFTSVGVNGGENNQGPSDQGDIEANLDIQYAVALSYKTPITYYITGGRGPLVPDLDQPDPNDVSNEPYLEFFSYLLKLPDSELPQTLTTSYGEDEQSVPRPYAEKVCQMIGQLGARGVSVIFSSGDTGVGSACQTNDGKNTTRFLPIFPGACPYVTSIGATRYVEPEQAAAFSSGGFSDIFKRPAYQEAAVSTYLHKHLGSRWKGLYNPQGRGFPDVSAQGVAYHVFSQDKDIKVSGTSASAPLFAALVSLLNNARLAQGRPPLGFLNPWLYSEKVQKAGALTDIVHGGSSGCTGKDMYSGLPTPYVPYASWNATPGWDPVTGLGTPVFDKLLELSSPGKKLPHIGGGHGHGAGGH

SEQ ID NO: 237 - protein, 613 aa, Gibberella zeae
MLAINLLKTGGFLFSAASVLAVPVVVESLNETPAGWEESDSPSPDEFINLSIGLEPEDHKLLERTIYEVSDPDHHNYGKHLSRESAKALLRPSSAATKSVERWLSEAGVPDHHVRDEGEWLHIQTTVKNAEGMLNTRFSVFARDDRSIVRTREYSVPHEIRRHISSIQPTTLFSSFQHTQSLEETAPTVMKRYVQGEKEPRSTKNGNYGGPGPVDLKKCKTEATPACIRKLYNLPKKYPNAAKGSLYTTVSFQNMTSQRDELQEFLRRYAPDLKGVTFADDFANGGKNTQGDNVPENEGNLNTQYAVSLASRVPIQHLAVGGINTDYISDLDLPPGQGIETWLEFAEHILNLPTKKLPSVISISWGEYEQHLPKKYARQVCNKFGQIGTRGVSIIVPAGNQGVGVACQSNDGKKTKKFLPTWPSACPYVTTVGGTGGNNPEIALSDGEGEPFSTGGGFSDLFPRPEYQEKAVKEYLKKYGKKWQAYYNPKGRAYPDVAAIAAELPVMVRGEVRPATGTSAAAPTFGAIVALLSNERLRKGKPAMGFLNPWIYKKGYKGFTDIVDGRNYGCQGFSLQDTLAPEIPGAGWEAVKGWDPVSGFGTPLYDKLEKLAL

SEQ ID NO: 238 - protein, 610 aa, Thielavia terrestris
MLQQLFVTAALAALGQCGLTVLESLPAQPRGWTRVGDASPDHTLKLRIALHQPNEALFERTLYEISDPFHAKYGQHLSRDELSALMAPRAESTSAVVSWLRDAGIASSNIEEDGEWIHVKMTVREASALLDADFGLWAHDGTNVKRVRALKYSVPDEVVEHVKMVAPIVRFGQMRPQRSQIFEVVDSKTPEPKAAAIPPQTLNATACNATITPECLRALYNVGSYQADPSEHSLFGVSGYLEEWAKYDQLELFTHTYAPYAAESNFTAVLVNGGVNNQGPSTQDDIEANLDIQYAVAMSYKTPINYYSTGGRGPVVPDLTEPDPNDSSNEPYLDFFGYLLKLPDSELPQTLSTSYGEDEQSVPRAFAEKVCQMIGQLGARGVSVIFSSGDSGVGSGCQTNDGKNTTRFLPIFPAACPYVTSVGATRYVNPEYAVSFSSGGFSDIFPRPLYQELAVTSYLTQHLGKRWAGLYNPGGRGFPDVAAQGVRYHVFSGGRDVLVSGTSASAPLFASLVSLLNNARLARGLPPLGFLNPWLYAVGWAGLTDIQHGGSTGCTANDSSSGVPTPYVPYASWNATPGWDPVTGLGTPNLEKLLDLSTPGWRLPRIGDWK

SEQ ID NO: 239 - protein, 623 aa, Magnaporthe oryzae
MEPTEPYPYPRGPTPPFVIAYAALATVLPLSASAASNVVVESLPAVPEGWEKIQDADPDSKIRLKVALRQPNLALFEREMYAVSSPLSARYGKHLKREEVRDLMKPDPASTSTVMQWLENAGIPSQAIHEDSDWINIVTSVRNASALLKADFGVYGHANSDLKKIRALEYSVPDNVRDHITMVAPIIRFGEIKPKRSIVKSVEDSKGSIQAAEVPTGQLDVAACNKTITPECLRALYQIGDYKATGSPKSRFGIAGYLEEYARYSELEKFQEVYAPYTLGSNFSVVTINGGLNDQSSTADSVEANLDMQYGVALGYNTNIVYYSTGGRGPLVPDLDQPNGNDSSNEPYLDFLEYMKNLPDDELPQTLTTSYGENEQSVPREFAVKVCNMFGELGARGVSIFFSSGDEGPGSACQSNDGKNTTRFDPAFPAACPYVTAVGGTRYVAPETGAALAGGGFSDIWPQPEWQKTAVEKYLSILGDKWKGLYNPSGRAYPDIAGQAYSYHVFDSGKDVLVAGTSASSPSVAAIFALLNDARLAANQPPMGWINPWLYEIGLKGLTDITVGGSRGCTGKSIYSGLPAPKVPFASWNATEGWDPVTGLGTPLFNKLLELSTPGAQAQKIAN

SEQ ID NO: 240 - protein, 388 aa, Trichoderma reesei
MAWLKKLALVLLAIVPYATASPALSPRSREILSLEDLESEDKYVIGLKQGLSPTDLKKHLLRVSAVQYRNKNSTFEGGTGVKRTYAIGDYRAYTAVLDRDTVREIWNDTLEKPPWGLATLSNKKPHGFLYRYDKSAGEGTFAYVLDTGINSKHVDFEGRAYMGFSPPKTEPTDINGHGTHVAGIIGGKTFGVAKKTQLIGVKVFLDDEATTSTLMEGLEWAVNDITTKGRQGRSVINMSLGGPYSQALNDAIDHIADMGILPVAAAGNKGIPATFISPASADKAMTVGAINSDWQETNFSNFGPQVNILAPGEDVLSAYVSTNTATRVLSGTSMAAPHVAGLALYLMALEEFDSTQKLTDRILQLGMKNKVVNLMTDSPNLIIHNNVK

SEQ ID NO: 241 - protein, 411 aa, Trichoderma atroviride
MAWFKHVALLLIAALPRITALPVNDANDANDANENSISAEGRYIVTLQNNIPMPEVRNHMSRVAAIQYRNSGNHKLPHTGIEKAYAIGEFRAYVGAFDLDTLQMIRNDTRVAEIEPDTVVSIREETSYKAASQSNAPWGLATLSSKRRNTGTYHYDTSAGNGTFAYVLDSGINVNHIEFEGRASNGYNAVDGDFTDIQGHGTHCAGIIGSKSYGVAKKAQLIAVKTFRNQETLMSTVMDAYQWSANDIRTKNRVGLAVINMSLGGSYSRAMNHAVESAFDMGILTIVAAGNEGRPARLVSPASAANAFTVGAIDADWHQWEHSNFGPEVNIFAPGVNIESTYISTDMATRKLSGTSMAAPHVAGLALYLCALEKIDNPITLRERILDLGTRGRIHKLRGESPNLIAHNNLH

SEQ ID NO: 242 - protein, 407 aa, Trichoderma virens
MAWFKKLALLLITVSPCVTAYPFNKTGRRLALNLDALEPEAKYIVTLQKDLTPTQFKNHIAKVNGTYYRSSQDNKQSSPSGLERTYAIGGYRAYSGTFDKDTIASLWSDAVVAEIELDDYFTVQKLVTQRHAPWGLAALSSKKPGSESYRYDKSAGNGTFAYVIDTGINTKHVEFGGRASVGYSVIADDFSDNSGHGTHVSGIIGGKTFGVAKQTEIIGVKVFLNNGGENSDVIDGLQWAVRDILAKGRQSRSVINMSLGGPYSYALNHAVDAAFEMGILVVVAAGNDAEPARYSSPASSSQALTVGAIDIQWRRCGFSNFGPEVNIEAPGEDIESAFIATDNATAILDGTSMATPHITGLALYLAALEKTKTAKELRDKVLEVAIKDKAKDLTLETPNLIAHNGAR

SEQ ID NO: 243 - DNA, 57 bp, Artificial Sequence
  Synthetic Construct
gtaacgccagggttttcccagtcacgacggtttaaacgtattgcgatgagcagcaga

SEQ ID NO: 244 - DNA, 43 bp, Artificial Sequence
  Synthetic Construct
atccacttaacgttactgaaatctggtctcctaacccaccaag

SEQ ID NO: 245 - DNA, 43 bp, Artificial Sequence
  Synthetic Construct
ctccttcaatatcatcttctgtctgtgaaatgaggtcccttcc

SEQ ID NO: 246 - DNA, 57 bp, Artificial Sequence
  Synthetic Construct
gcggataacaatttcacacaggaaacagcgtttaaaccaaacgcagcagaaaccata

SEQ ID NO: 247 - DNA, 51 bp, Artificial Sequence
  Synthetic Construct
gatttcagtaacgttaagtggatgcggccgcgacagaagatgatattgaag

SEQ ID NO: 248 - DNA, 50 bp, Artificial Sequence
  Synthetic Construct
gacagaagatgatattgaaggaggcggccgcttaagtggatcccggtgac

SEQ ID NO: 249 - DNA, 68 bp, Artificial Sequence
  Synthetic Construct
ggtgggttaggagaccagatttcagtaacgttaagtggatgcggccgcctagcatcgactactgctgc

SEQ ID NO: 250 - DNA, 46 bp, Artificial Sequence
  Synthetic Construct
gcagcagtagtcgatgctaggcgcgccatgcaaagatacacatcaa

SEQ ID NO: 251 - DNA, 46 bp, Artificial Sequence
  Synthetic Construct
ttgatgtgtatctttgcatggcgcgcctagcatcgactactgctgc

SEQ ID NO: 252 - DNA, 68 bp, Artificial Sequence
  Synthetic Construct
agggacctcatttcacagacagaagatgatattgaaggaggcggccgcggctgatgaggctgagagag

SEQ ID NO: 253 - DNA, 20 bp, Artificial Sequence
  Synthetic Construct
tcgctgtaacgaacttctgt

SEQ ID NO: 254 - DNA, 20 bp, Artificial Sequence
  Synthetic Construct
cattgttgacctccactagc

SEQ ID NO: 255 - DNA, 20 bp, Artificial Sequence
  Synthetic Construct
gctgctgatcggacattttt

SEQ ID NO: 256 - DNA, 18 bp, Artificial Sequence
  Synthetic Construct
gtttctggcagctggact

SEQ ID NO: 257 - DNA, 20 bp, Artificial Sequence
  Synthetic Construct
tcgctgtaacgaacttctgt

SEQ ID NO: 258 - DNA, 20 bp, Artificial Sequence
  Synthetic Construct
tgcgtcgccgtctcgctcct

SEQ ID NO: 259 - DNA, 20 bp, Artificial Sequence
  Synthetic Construct
cgacgatctacagccatctg

SEQ ID NO: 260 - DNA, 20 bp, Artificial Sequence
  Synthetic Construct
acccaaagcgtccttcatta

SEQ ID NO: 261 - DNA, 57 bp, Artificial Sequence
  Synthetic Construct
gtaacgccagggttttcccagtcacgacggtttaaacttcagttgtggcatctcagc

SEQ ID NO: 262 - DNA, 68 bp, Artificial Sequence
  Synthetic Construct
gccaagcccaaaaagtgctccttcaatatcatcttctgtcgcggccgcgggaagcaagtttcgaagtg

SEQ ID NO: 263 - DNA, 68 bp, Artificial Sequence
  Synthetic Construct
cccgtcaccgagatctgatccgtcaccgggatccacttaagcggccgcaatggatgaggtgtggcttc

SEQ ID NO: 264 - DNA, 57 bp, Artificial Sequence
  Synthetic Construct
gcggataacaatttcacacaggaaacagcgtttaaactcctcaccgaagagcaagtc

SEQ ID NO: 265 - DNA, 57 bp, Artificial Sequence; identical to SEQ ID NO: 261
  Synthetic Construct

SEQ ID NO: 266 - DNA, 20 bp, Artificial Sequence
  Synthetic Construct
cattgttgacctccactagc

SEQ ID NO: 267 - DNA, 19 bp, Artificial Sequence
  Synthetic Construct
cgtcaccgagatctgatcc

SEQ ID NO: 268 - DNA, 57 bp, Artificial Sequence; identical to SEQ ID NO: 264
  Synthetic Construct

SEQ ID NO: 269 - DNA, 20 bp, Artificial Sequence
  Synthetic Construct
gacgtggtacgacaacatcg

SEQ ID NO: 270 - DNA, 20 bp, Artificial Sequence
  Synthetic Construct
tatcaaggtaccggggacag

SEQ ID NO: 271 - DNA, 67 bp, Artificial Sequence
  Synthetic Construct
gattaagttgggtaacgccagggttttcccagtcacgacggtttaaacacctcatgagggactatgg

SEQ ID NO: 272 - DNA, 69 bp, Artificial Sequence
  Synthetic Construct
gcgctggcaacgagagcagagcagcagtagtcgatgctaggcggccgccaagaagaggcagagggtaat

SEQ ID NO: 273 - DNA, 68 bp, Artificial Sequence
  Synthetic Construct
caaccagccgcagcctcagcctctctcagcctcatcagccgcggccgcctatacatactgatgataca

SEQ ID NO: 274 - DNA, 68 bp, Artificial Sequence
  Synthetic Construct
tggaattgtgagcggataacaatttcacacaggaaacagcgtttaaacgccccatgtatggactctac

SEQ ID NO: 275 - DNA, 22 bp, Artificial Sequence
  Synthetic Construct
ctcagaaaggttgtagttgtga

SEQ ID NO: 276 - DNA, 20 bp, Artificial Sequence
  Synthetic Construct
ccatgagcttgaacaggtaa

SEQ ID NO: 277 - DNA, 22 bp, Artificial Sequence
  Synthetic Construct
gatgttgtgttttcagtctgca

SEQ ID NO: 278 - DNA, 19 bp, Artificial Sequence
  Synthetic Construct
catcctcaaggcctcagac

SEQ ID NO: 279 - DNA, 19 bp, Artificial Sequence
  Synthetic Construct
atgttcatcgctggcgtcg

SEQ ID NO: 280 - DNA, 21 bp, Artificial Sequence
  Synthetic Construct
ctaaacgtaagagcaggtcaa

SEQ ID NO: 281 - DNA, 67 bp, Artificial Sequence
  Synthetic Construct
gattaagttgggtaacgccagggttttcccagtcacgacggtttaaacgctactacgcgagcaagtg

SEQ ID NO: 282 - DNA, 66 bp, Artificial Sequence
  Synthetic Construct
ggaactgtcggcgattgggagaatttcgtgcgatcgcggcggccgccggatgaagatgtgcagttg

SEQ ID NO: 283 - DNA, 69 bp, Artificial Sequence
  Synthetic Construct
agggaacatatcaccctcgggcatttttcatttggtaggcggccgctaagatatcttcaagcttatgcg

SEQ ID NO: 284 - DNA, 20 bp, Artificial Sequence
  Synthetic Construct
cggatgaagatgtgcagttg

SEQ ID NO: 285 - DNA, 61 bp, Artificial Sequence
  Synthetic Construct
tgtctcacttccacccatctcaactgcacatcttcatccgagcaacaacatgaggttcgaa

SEQ ID NO: 286 - DNA, 69 bp, Artificial Sequence
  Synthetic Construct
cctatgttgtgtggaattgtgagcggataacaatttcacagtttaaacacaacgcatgtccagcttttg

SEQ ID NO: 287 - DNA, 19 bp, Artificial Sequence
  Synthetic Construct
gcttggcatcacggaagct

SEQ ID NO: 288 - DNA, 20 bp, Artificial Sequence
  Synthetic Construct
ccatgagcttgaacaggtaa

SEQ ID NO: 289 - DNA, 21 bp, Artificial Sequence
  Synthetic Construct
ttgacaagaaaggtccggttg

SEQ ID NO: 290 - DNA, 19 bp, Artificial Sequence
  Synthetic Construct
catcctcaaggcctcagac

SEQ ID NO: 291 - DNA, 20 bp, Artificial Sequence
  Synthetic Construct
atggatgctatccgagccag

SEQ ID NO: 292 - DNA, 22 bp, Artificial Sequence
  Synthetic Construct
ctattcatactcaacagtcaca

SEQ ID NO: 293 - DNA, 58 bp, Artificial Sequence
  Synthetic Construct
gtaacgccagggttttcccagtcacgacggtttaaactgctgttgctgtttgttgatg

SEQ ID NO: 294 - DNA, 69 bp, Artificial Sequence
  Synthetic Construct
cccgtcaccgagatctgatccgtcaccgggatccacttaagcggccgcctgtggtgagatctccagacg

SEQ ID NO: 295 - DNA, 69 bp, Artificial Sequence
  Synthetic Construct
gccaagcccaaaaagtgctccttcaatatcatcttctgtcgcggccgcactgtgcccaacaataagcag

SEQ ID NO: 296 - DNA, 55 bp, Artificial Sequence
  Synthetic Construct
gcggataacaatttcacacaggaaacagcgtttaaacccaaggcgctggctgtta

SEQ ID NO: 297 - DNA, 20 bp, Artificial Sequence
  Synthetic Construct
gatcgacaaaggttccagcg

SEQ ID NO: 298 - DNA, 20 bp, Artificial Sequence
  Synthetic Construct
aattgtatcattccgaggct

SEQ ID NO: 299 - DNA, 19 bp, Artificial Sequence
  Synthetic Construct
ctgtttggccctcgaaact

SEQ ID NO: 300 - DNA, 20 bp, Artificial Sequence
  Synthetic Construct
cattgttgacctccactagc

SEQ ID NO: 301 - DNA, 20 bp, Artificial Sequence
  Synthetic Construct
ttcgccatccaaatttcttc

SEQ ID NO: 302 - DNA, 18 bp, Artificial Sequence
  Synthetic Construct
gtttctggcagctggact

SEQ ID NO: 303 - DNA, 19 bp, Artificial Sequence
  Synthetic Construct
ctgtttggccctcgaaact

SEQ ID NO: 304 - DNA, 20 bp, Artificial Sequence
  Synthetic Construct
tgcgtcgccgtctcgctcct

SEQ ID NO: 305 - DNA, 20 bp, Artificial Sequence
  Synthetic Construct
ttcgccatccaaatttcttc

SEQ ID NO: 306 - DNA, 19 bp, Artificial Sequence
  Synthetic Construct
catcctcaaggcctcagac

SEQ ID NO: 307 - DNA, 20 bp, Artificial Sequence
  Synthetic Construct
cccaagtcgtctcagctctc

SEQ ID NO: 308 - DNA, 21 bp, Artificial Sequence
  Synthetic Construct
tcgaaggcttcagtgaggtaa

SEQ ID NO: 309 - DNA, 57 bp, Artificial Sequence
  Synthetic Construct
gtaacgccagggttttcccagtcacgacggtttaaacatctcggagtgatgcttcct

SEQ ID NO: 310 - DNA, 68 bp, Artificial Sequence
  Synthetic Construct
gcgctggcaacgagagcagagcagcagtagtcgatgctaggcggccgcatcagacgaaaccagacgag

SEQ ID NO: 311 - DNA, 68 bp, Artificial Sequence
  Synthetic Construct
caaccagccgcagcctcagcctctctcagcctcatcagccgcggccgcgcgaatcgagttgatgattc

SEQ ID NO: 312 - DNA, 57 bp, Artificial Sequence
  Synthetic Construct
gcggataacaatttcacacaggaaacagcgtttaaacctggttgggatctgaccact

SEQ ID NO: 313 - DNA, 20 bp, Artificial Sequence
  Synthetic Construct
gcagacaaacagagcaacga

SEQ ID NO: 314 - DNA, 20 bp, Artificial Sequence
  Synthetic Construct
ccatgagcttgaacaggtaa

SEQ ID NO: 315 - DNA, 20 bp, Artificial Sequence
  Synthetic Construct
tagagggtgtcgatggaagc

SEQ ID NO: 316 - DNA, 19 bp, Artificial Sequence
  Synthetic Construct
catcctcaaggcctcagac

SEQ ID NO: 317 - DNA, 20 bp, Artificial Sequence
  Synthetic Construct
ggtctcttctttgccagcac

SEQ ID NO: 318 - DNA, 20 bp, Artificial Sequence
  Synthetic Construct
tgtcgctgaactgaatttgc

SEQ ID NO: 319 - DNA, 67 bp, Artificial Sequence
  Synthetic Construct
gattaagttgggtaacgccagggttttcccagtcacgacggtttaaacgcagtctatcccatccctg

SEQ ID NO: 320 - DNA, 68 bp, Artificial Sequence
  Synthetic Construct
gcgctggcaacgagagcagagcagcagtagtcgatgctaggcggccgcgcggatgatgaaggaagaag

SEQ ID NO: 321 - DNA, 68 bp, Artificial Sequence
  Synthetic Construct
caaccagccgcagcctcagcctctctcagcctcatcagccgcggccgcaacagctgttcgcacgcgtg

SEQ ID NO: 322 - DNA, 66 bp, Artificial Sequence
  Synthetic Construct
tggaattgtgagcggataacaatttcacacaggaaacagcgtttaaacggctgggcattggggccg

SEQ ID NO: 323 - DNA, 68 bp, Artificial Sequence
  Synthetic Construct
gattaagttgggtaacgccagggttttcccagtcacgacggtttaaacaaacaaggcacaaaggcctg

SEQ ID NO: 324 - DNA, 67 bp, Artificial Sequence
  Synthetic Construct
gcgctggcaacgagagcagagcagcagtagtcgatgctaggcggccgcatccaaggatgaggagaac

SEQ ID NO: 325 - DNA, 71 bp, Artificial Sequence
  Synthetic Construct
caaccagccgcagcctcagcctctctcagcctcatcagccgcggccgcacctaatggtttcttcgtttttc

SEQ ID NO: 326 - DNA, 68 bp, Artificial Sequence
  Synthetic Construct
tggaattgtgagcggataacaatttcacacaggaaacagcgtttaaaccggtccgaagggtgttttgg

SEQ ID NO: 327 - DNA, 17 bp, Artificial Sequence
  Synthetic Construct
gatgcaccgctgcggcc

SEQ ID NO: 328 - DNA, 20 bp, Artificial Sequence
  Synthetic Construct
ccatgagcttgaacaggtaa

SEQ ID NO: 329 - DNA, 19 bp, Artificial Sequence
  Synthetic Construct
catcctcaaggcctcagac

SEQ ID NO: 330 - DNA, 18 bp, Artificial Sequence
  Synthetic Construct
ggcgttgctccccatgcg

SEQ ID NO: 331 - DNA, 18 bp, Artificial Sequence
  Synthetic Construct
atgcggtccgttgtcgcc

SEQ ID NO: 332 - DNA, 20 bp, Artificial Sequence
  Synthetic Construct
ttactcggagagctcagaga

SEQ ID NO: 333 - DNA, 20 bp, Artificial Sequence
  Synthetic Construct
gtgaatgggtggcaacatga

SEQ ID NO: 334 - DNA, 20 bp, Artificial Sequence
  Synthetic Construct
ccatgagcttgaacaggtaa

SEQ ID NO: 335 - DNA, 19 bp, Artificial Sequence
  Synthetic Construct
catcctcaaggcctcagac

SEQ ID NO: 336 - DNA, 21 bp, Artificial Sequence
  Synthetic Construct
catcaagttgaccaccattgt

SEQ ID NO: 337 - DNA, 19 bp, Artificial Sequence
  Synthetic Construct
atgcggttgtccgtcctcc

SEQ ID NO: 338 - DNA, 20 bp, Artificial Sequence
  Synthetic Construct
ttaaccggaagggttgccgt

SEQ ID NO: 339 - DNA, 19 bp, Artificial Sequence
  Synthetic Construct
ctgtttggccctcgaaact

SEQ ID NO: 340 - DNA, 20 bp, Artificial Sequence
  Synthetic Construct
ccatgagcttgaacaggtaa

SEQ ID NO: 341 - DNA, 20 bp, Artificial Sequence
  Synthetic Construct
ttcgccatccaaatttcttc

SEQ ID NO: 342 - DNA, 19 bp, Artificial Sequence
  Synthetic Construct
catcctcaaggcctcagac

SEQ ID NO: 343 - DNA, 20 bp, Artificial Sequence
  Synthetic Construct
gcagacaaacagagcaacga

SEQ ID NO: 344 - DNA, 20 bp, Artificial Sequence
  Synthetic Construct
ccatgagcttgaacaggtaa

SEQ ID NO: 345 - DNA, 20 bp, Artificial Sequence
  Synthetic Construct
tagagggtgtcgatggaagc

SEQ ID NO: 346 - DNA, 19 bp, Artificial Sequence
  Synthetic Construct
catcctcaaggcctcagac

SEQ ID NO: 347 - DNA, 20 bp, Artificial Sequence
  Synthetic Construct
ggtctcttctttgccagcac

SEQ ID NO: 348 - DNA, 20 bp, Artificial Sequence
  Synthetic Construct
tgtcgctgaactgaatttgc

SEQ ID NO: 349 - DNA, 20 bp, Artificial Sequence
  Synthetic Construct
gcagacaaacagagcaacga

SEQ ID NO: 350 - DNA, 20 bp, Artificial Sequence
  Synthetic Construct
ccatgagcttgaacaggtaa

SEQ ID NO: 351 - DNA, 20 bp, Artificial Sequence
  Synthetic Construct
tagagggtgtcgatggaagc

SEQ ID NO: 352 - DNA, 19 bp, Artificial Sequence
  Synthetic Construct
catcctcaaggcctcagac

SEQ ID NO: 353 - DNA, 22 bp, Artificial Sequence
  Synthetic Construct
ctcagaaaggttgtagttgtga

SEQ ID NO: 354 - DNA, 20 bp, Artificial Sequence
  Synthetic Construct
ccatgagcttgaacaggtaa

SEQ ID NO: 355 - DNA, 22 bp, Artificial Sequence
  Synthetic Construct
gatgttgtgttttcagtctgca

SEQ ID NO: 356 - DNA, 19 bp, Artificial Sequence
  Synthetic Construct
catcctcaaggcctcagac

SEQ ID NO: 357 - DNA, 19 bp, Artificial Sequence
  Synthetic Construct
atgttcatcgctggcgtcg

SEQ ID NO: 358 - DNA, 21 bp, Artificial Sequence
  Synthetic Construct
ctaaacgtaagagcaggtcaa

SEQ ID NO: 359 - DNA, 22 bp, Artificial Sequence
  Synthetic Construct
ctcagaaaggttgtagttgtga

SEQ ID NO: 360 - DNA, 20 bp, Artificial Sequence
  Synthetic Construct
ccatgagcttgaacaggtaa

SEQ ID NO: 361 - DNA, 22 bp, Artificial Sequence
  Synthetic Construct
gatgttgtgttttcagtctgca

SEQ ID NO: 362 - DNA, 19 bp, Artificial Sequence
  Synthetic Construct
catcctcaaggcctcagac

SEQ ID NO: 363 - DNA, 19 bp, Artificial Sequence
  Synthetic Construct
gcttggcatcacggaagct

SEQ ID NO: 364 - DNA, 20 bp, Artificial Sequence
  Synthetic Construct
ccatgagcttgaacaggtaa

SEQ ID NO: 365 - DNA, 21 bp, Artificial Sequence
  Synthetic Construct
ttgacaagaaaggtccggttg

SEQ ID NO: 366 - DNA, 19 bp, Artificial Sequence
  Synthetic Construct
catcctcaaggcctcagac

SEQ ID NO: 367 - DNA, 20 bp, Artificial Sequence
  Synthetic Construct
atggatgctatccgagccag

SEQ ID NO: 368 - DNA, 22 bp, Artificial Sequence
  Synthetic Construct
ctattcatactcaacagtcaca

SEQ ID NO: 369 - DNA, 57 bp, Artificial Sequence
  Synthetic Construct
gtaacgccagggttttcccagtcacgacggtttaaactcaggtcaaccaccgaggac

SEQ ID NO: 370 - DNA, 68 bp, Artificial Sequence
  Synthetic Construct
cccgtcaccgagatctgatccgtcaccgggatccacttaagcggccgctgaatgggatggttcgattg

SEQ ID NO: 371 - DNA, 68 bp, Artificial Sequence
  Synthetic Construct
gccaagcccaaaaagtgctccttcaatatcatcttctgtcgcggccgcaggtagacgctttgcgagtg

SEQ ID NO: 372 - DNA, 55 bp, Artificial Sequence
  Synthetic Construct
gcggataacaatttcacacaggaaacagcgtttaaactgaactgacgcggactga

SEQ ID NO: 373 - DNA, 68 bp, Artificial Sequence
  Synthetic Construct
aagttcccttcctctggcagcaatcgaaccatcccattcagcggccgcctagcatcgactactgctgc

SEQ ID NO: 374 - DNA, 20 bp, Artificial Sequence
  Synthetic Construct
catgcaaagatacacatcaa

SEQ ID NO: 375 - DNA, 68 bp, Artificial Sequence
  Synthetic Construct
tgattgtaccccagctgcgattgatgtgtatctttgcatggcggccgctcaatgttgactgccccagg

SEQ ID NO: 376 - DNA, 68 bp, Artificial Sequence
  Synthetic Construct
gcacttcttagatacacacacactcgcaaagcgtctacctggcgcgcctgaatgggatggttcgattg

SEQ ID NO: 377 - DNA, 21 bp, Artificial Sequence
  Synthetic Construct
ggcaggtcgcagagcaagaca

SEQ ID NO: 378 - DNA, 21 bp, Artificial Sequence
  Synthetic Construct
ttgacaagaaaggtccggttg

SEQ ID NO: 379 - DNA, 20 bp, Artificial Sequence
  Synthetic Construct
gattcatcacaggggcagtc

SEQ ID NO: 380 - DNA, 20 bp, Artificial Sequence
  Synthetic Construct
tgcgtcgccgtctcgctcct

SEQ ID NO: 381 - DNA, 19 bp, Artificial Sequence
  Synthetic Construct
acgccgttgctgagccttg

SEQ ID NO: 382 - DNA, 20 bp, Artificial Sequence
  Synthetic Construct
ttaggcgacctctttttcca

SEQ ID NO: 383 - DNA, 20 bp, Artificial Sequence
  Synthetic Construct
gagcccatcatcaacacctc

SEQ ID NO: 384 - DNA, 19 bp, Artificial Sequence
  Synthetic Construct
tgccaaggtcgtagacgga

SEQ ID NO: 385 - DNA, 58 bp, Artificial Sequence
  Synthetic Construct
ggtaacgccagggttttcccagtcacgacggtttaaacgtcgagccccctggacacct

SEQ ID NO: 386 - DNA, 68 bp, Artificial Sequence
  Synthetic Construct
gcgctggcaacgagagcagagcagcagtagtcgatgctaggcggccgccatcgccgtcgcggacatga

SEQ ID NO: 387 - DNA, 68 bp, Artificial Sequence
  Synthetic Construct
tgattgtaccccagctgcgattgatgtgtatctttgcatggcggccgctcgacgttgtatctgcactc

SEQ ID NO: 388 - DNA, 68 bp, Artificial Sequence
  Synthetic Construct
gtacgttctgattgccaactacggaccagaccagggctccggcgcgcccatcgccgtcgcggacatga

SEQ ID NO: 389 - DNA, 20 bp, Artificial Sequence
  Synthetic Construct
ggagccctggtctggtccgt

SEQ ID NO: 390 - DNA, 58 bp, Artificial Sequence
  Synthetic Construct
agcggataacaatttcacacaggaaacagcgtttaaacacgcgcttcaacatgcccca

SEQ ID NO: 391 - DNA, 60 bp, Artificial Sequence
  Synthetic Construct
gctggccgctgggaatagcgtcatgtccgcgacggcgatggaattcggtctgaaggacgt

SEQ ID NO: 392 - DNA, 22 bp, Artificial Sequence
  Synthetic Construct
gttgagagaagttgttggattg

SEQ ID NO: 393 - DNA, 62 bp, Artificial Sequence
  Synthetic Construct
aaccaaagactttttgatcaatccaacaacttctctcaacatgaagatttcctcgatccttg

SEQ ID NO: 394 - DNA, 19 bp, Artificial Sequence
  Synthetic Construct
tcagcgccgtaacctctgc

SEQ ID NO: 395 - DNA, 61 bp, Artificial Sequence
  Synthetic Construct
tgatggtgatgaggcggaaaagcagaggttacggcgctgaggatccacttaacgttactga

SEQ ID NO: 396 - DNA, 71 bp, Artificial Sequence
  Synthetic Construct
tctctcaaaggaagaatcccttcagggttgcgtttccagtgcggccgctctccttctagaaagaaggatta

SEQ ID NO: 397 - DNA, 20 bp, Artificial Sequence
  Synthetic Construct
actggaaacgcaaccctgaa

SEQ ID NO: 398 - DNA, 58 bp, Artificial Sequence
  Synthetic Construct
tctgattgccaactacggaccagaccagggctccggcgcggcggccgctagatctacg

SEQ ID NO: 399 - DNA, 66 bp, Artificial Sequence
  Synthetic Construct
gtacacttgtttagaggtaatccttctttctagaaggagagcggccgcggagccctggtctggtcc

SEQ ID NO: 400 - DNA, 59 bp, Artificial Sequence
  Synthetic Construct
gcgctggcaacgagagcagagcagcagtagtcgatgctagaagctgacgggcgtcaacg

SEQ ID NO: 401 - DNA, 19 bp, Artificial Sequence
  Synthetic Construct
tagcatcgactactgctgc

SEQ ID NO: 402 - DNA, 70 bp, Artificial Sequence
  Synthetic Construct
gtacgttctgattgccaactacggaccagaccagggctccgcggccgccatgcaaagatacacatcaatc

SEQ ID NO: 403 - DNA, 20 bp, Artificial Sequence
  Synthetic Construct
gattcatcacaggggcagtc

SEQ ID NO: 404 - DNA, 20 bp, Artificial Sequence
  Synthetic Construct
ccgctctcaaactgcccaaa

SEQ ID NO: 405 - DNA, 19 bp, Artificial Sequence
  Synthetic Construct
acgtgaagttgcccatcaa

SEQ ID NO: 406 - DNA, 20 bp, Artificial Sequence
  Synthetic Construct
ccatgagcttgaacaggtaa

SEQ ID NO: 407 - DNA, 20 bp, Artificial Sequence
  Synthetic Construct
gaccaatggcttcacgaagt

SEQ ID NO: 408 - DNA, 20 bp, Artificial Sequence
  Synthetic Construct
ttaggcgacctctttttcca

SEQ ID NO: 409 - DNA, 19 bp, Artificial Sequence
  Synthetic Construct
acgtgaagttgcccatcaa

SEQ ID NO: 410 - DNA, 24 bp, Artificial Sequence
  Synthetic Construct
taacttgtacgctctcagttcgag

SEQ ID NO: 411 - DNA, 20 bp, Artificial Sequence
  Synthetic Construct
gaccaatggcttcacgaagt

SEQ ID NO: 412 - DNA, 20 bp, Artificial Sequence
  Synthetic Construct
ttaggcgacctctttttcca

SEQ ID NO: 413 - DNA, 20 bp, Artificial Sequence
  Synthetic Construct
cagcagcaccgcatccacca

SEQ ID NO: 414 - DNA, 20 bp, Artificial Sequence
  Synthetic Construct
gccgaatcgctggttgccct

SEQ ID NO: 415 - DNA, 19 bp, Artificial Sequence
  Synthetic Construct
atggaagccatcctccagg

SEQ ID NO: 416 - DNA, 18 bp, Artificial Sequence
  Synthetic Construct
tggatcatgttggcgacg

SEQ ID NO: 417 - DNA, 17 bp, Artificial Sequence
  Synthetic Construct
gtaagacgccccgtctc

SEQ ID NO: 418 - DNA, 58 bp, Artificial Sequence
  Synthetic Construct
ggtaacgccagggttttcccagtcacgacggtttaaacggaggctgcgacaccgtctg

SEQ ID NO: 419 - DNA, 68 bp, Artificial Sequence
  Synthetic Construct
gcgctggcaacgagagcagagcagcagtagtcgatgctaggcggccgcccggcctgaaacgacctccc

SEQ ID NO: 420 - DNA, 68 bp, Artificial Sequence
  Synthetic Construct
cccgtcaccgagatctgatccgtcaccgggatccacttaagcggccgcgagagagaaacaaaacagtg

SEQ ID NO: 421 - DNA, 68 bp, Artificial Sequence
  Synthetic Construct
acattccgaccgtttactgatccaagccgtgcaaccgactggcgcgccccggcctgaaacgacctccc

SEQ ID NO: 422 - DNA, 20 bp, Artificial Sequence
  Synthetic Construct
agtcggttgcacggcttgga

SEQ ID NO: 423 - DNA, 58 bp, Artificial Sequence
  Synthetic Construct
agcggataacaatttcacacaggaaacagcgtttaaacgagacggacgcctgcaccac

SEQ ID NO: 424 - DNA, 68 bp, Artificial Sequence
  Synthetic Construct
tgattgtaccccagctgcgattgatgtgtatctttgcatggcgatcgcgacagaagatgatattgaag

SEQ ID NO: 425 - DNA, 20 bp, Artificial Sequence
  Synthetic Construct
ttaagtggatcccggtgacg

SEQ ID NO: 426 - DNA, 21 bp, Artificial Sequence
  Synthetic Construct
cctatgagtcgtttacccaga

SEQ ID NO: 427 - DNA, 18 bp, Artificial Sequence
  Synthetic Construct
tggccgagtctatgcgta

SEQ ID NO: 428 - DNA, 20 bp, Artificial Sequence
  Synthetic Construct
ggagttgctttaatgtcggg

SEQ ID NO: 429 - DNA, 20 bp, Artificial Sequence
  Synthetic Construct
ttaggcgacctctttttcca

SEQ ID NO: 430 - DNA, 17 bp, Artificial Sequence
  Synthetic Construct
gtaagacgccccgtctc

SEQ ID NO: 431 - DNA, 18 bp, Artificial Sequence
  Synthetic Construct
tggatcatgttggcgacg

SEQ ID NO: 432 - DNA, 20 bp, Artificial Sequence
  Synthetic Construct
gtcgaagatgtcctcgagat

SEQ ID NO: 433 - DNA, 20 bp, Artificial Sequence
  Synthetic Construct
ggagttgctttaatgtcggg

SEQ ID NO: 434 - DNA, 20 bp, Artificial Sequence
  Synthetic Construct
ttaggcgacctctttttcca

SEQ ID NO: 435 - DNA, 18 bp, Artificial Sequence
  Synthetic Construct
tagtccatgccgaactgc

SEQ ID NO: 436 - DNA, 20 bp, Artificial Sequence
  Synthetic Construct
ccggacctgcaccgcaagtt

SEQ ID NO: 437 - DNA, 20 bp, Artificial Sequence
  Synthetic Construct
agggcaatgtcgcccagcac

SEQ ID NO: 438 - DNA, 17 bp, Artificial Sequence
  Synthetic Construct
gacctgcaccgcaagtt

SEQ ID NO: 439 - DNA, 20 bp, Artificial Sequence
  Synthetic Construct
gtcgagcgtctgatattcac

SEQ ID NO: 440 - DNA, 17 bp, Artificial Sequence
  Synthetic Construct
gacggagacctcccaca

SEQ ID NO: 441 - DNA, 57 bp, Artificial Sequence
  Synthetic Construct
gtaacgccagggttttcccagtcacgacggtttaaaccataaacttgcgcagtcgaa

SEQ ID NO: 442 - DNA, 68 bp, Artificial Sequence
  Synthetic Construct
gcgctggcaacgagagcagagcagcagtagtcgatgctaggcggccgccttctaggatggagcgcttg

SEQ ID NO: 443 - DNA, 68 bp, Artificial Sequence
  Synthetic Construct
caaccagccgcagcctcagcctctctcagcctcatcagccgcggccgcagacggcttcttccaaaaca

SEQ ID NO: 444 - DNA, 57 bp, Artificial Sequence
  Synthetic Construct
gcggataacaatttcacacaggaaacagcgtttaaacccccagggaggctattctac

SEQ ID NO: 445 - DNA, 20 bp, Artificial Sequence
  Synthetic Construct
ctttccaagcgtttgagtcc

SEQ ID NO: 446 - DNA, 20 bp, Artificial Sequence
  Synthetic Construct
ccatgagcttgaacaggtaa

SEQ ID NO: 447 - DNA, 20 bp, Artificial Sequence
  Synthetic Construct
gcgtgttttatcctggtgct

SEQ ID NO: 448 - DNA, 19 bp, Artificial Sequence
  Synthetic Construct
catcctcaaggcctcagac

SEQ ID NO: 449 - DNA, 20 bp, Artificial Sequence
  Synthetic Construct
cacctccgtcgatgagtttt

SEQ ID NO: 450 - DNA, 20 bp, Artificial Sequence
  Synthetic Construct
agaagaaggtggtggtggtg

SEQ ID NO: 451 - DNA, 57 bp, Artificial Sequence
  Synthetic Construct
gtaacgccagggttttcccagtcacgacggtttaaacgtttgagcattctcccaagc

SEQ ID NO: 452 - DNA, 68 bp, Artificial Sequence
  Synthetic Construct
gcgctggcaacgagagcagagcagcagtagtcgatgctaggcggccgccgccattttgaagaagatgc

SEQ ID NO: 453 - DNA, 68 bp, Artificial Sequence
  Synthetic Construct
caaccagccgcagcctcagcctctctcagcctcatcagccgcggccgcatgctccctcgtcattaagc

SEQ ID NO: 454 - DNA, 57 bp, Artificial Sequence
  Synthetic Construct
gcggataacaatttcacacaggaaacagcgtttaaacacaacaccttctccgacacc

SEQ ID NO: 455 - DNA, 20 bp, Artificial Sequence
  Synthetic Construct
atgcccaagtttcgtacctg

SEQ ID NO: 456 - DNA, 20 bp, Artificial Sequence
  Synthetic Construct
ccatgagcttgaacaggtaa

SEQ ID NO: 457 - DNA, 20 bp, Artificial Sequence
  Synthetic Construct
ggcgcattcagaagaagaac

SEQ ID NO: 458 - DNA, 19 bp, Artificial Sequence
  Synthetic Construct
catcctcaaggcctcagac

SEQ ID NO: 459 - DNA, 20 bp, Artificial Sequence
  Synthetic Construct
cacttgatgaacgctggcta

SEQ ID NO: 460 - DNA, 20 bp, Artificial Sequence
  Synthetic Construct
cgtaatggcgttgttgacag

SEQ ID NO: 461 - DNA, 57 bp, Artificial Sequence
  Synthetic Construct
gtaacgccagggttttcccagtcacgacggtttaaacgaggcagccaaaaagtgaag

SEQ ID NO: 462 - DNA, 68 bp, Artificial Sequence
  Synthetic Construct
gcgctggcaacgagagcagagcagcagtagtcgatgctaggcggccgctgaaagaaggcaggaccagt

SEQ ID NO: 463 - DNA, 68 bp, Artificial Sequence
  Synthetic Construct
caaccagccgcagcctcagcctctctcagcctcatcagccgcggccgcaagaggctcggacaaagaca

SEQ ID NO: 464 - DNA, 57 bp, Artificial Sequence
  Synthetic Construct
gcggataacaatttcacacaggaaacagcgtttaaacgatcgtggtgcacgagacta

SEQ ID NO: 465 - DNA, 20 bp, Artificial Sequence
  Synthetic Construct
gcactgcgttgcctttctat

SEQ ID NO: 466 - DNA, 20 bp, Artificial Sequence
  Synthetic Construct
ccatgagcttgaacaggtaa

SEQ ID NO: 467 - DNA, 20 bp, Artificial Sequence
  Synthetic Construct
gaaagcatggctcgtttctc

SEQ ID NO: 468 - DNA, 19 bp, Artificial Sequence
  Synthetic Construct
catcctcaaggcctcagac

SEQ ID NO: 469 - DNA, 20 bp, Artificial Sequence
  Synthetic Construct
acccggctcaactagctaca

SEQ ID NO: 470 - DNA, 20 bp, Artificial Sequence
  Synthetic Construct
agctggcctttcgttacaga

SEQ ID NO: 471 - DNA, 57 bp, Artificial Sequence
  Synthetic Construct
gtaacgccagggttttcccagtcacgacggtttaaacttggtttgaacagctgcaag

SEQ ID NO: 472 - DNA, 68 bp, Artificial Sequence
  Synthetic Construct
gcgctggcaacgagagcagagcagcagtagtcgatgctaggcggccgctttgcagcaagatgtcgttc

SEQ ID NO: 473 - DNA, 68 bp, Artificial Sequence
  Synthetic Construct
caaccagccgcagcctcagcctctctcagcctcatcagccgcggccgcgctgtgaagacgggcttatc

SEQ ID NO: 474 - DNA, 57 bp, Artificial Sequence
  Synthetic Construct
gcggataacaatttcacacaggaaacagcgtttaaaccaagaacagcatcgaggaca

SEQ ID NO: 475 - DNA, 19 bp, Artificial Sequence
  Synthetic Construct
gggcgacgacgagttttat

SEQ ID NO: 476 - DNA, 20 bp, Artificial Sequence
  Synthetic Construct
ccatgagcttgaacaggtaa

SEQ ID NO: 477 - DNA, 20 bp, Artificial Sequence
  Synthetic Construct
gaatggatcaagtcgctgct

SEQ ID NO: 478 - DNA, 19 bp, Artificial Sequence
  Synthetic Construct
catcctcaaggcctcagac

SEQ ID NO: 479 - DNA, 20 bp, Artificial Sequence
  Synthetic Construct
ctcaggctctgcttggattc

SEQ ID NO: 480 - DNA, 20 bp, Artificial Sequence
  Synthetic Construct
atgccaaaaagactgctgct

SEQ ID NO: 481 - DNA, 57 bp, Artificial Sequence
  Synthetic Construct
gtaacgccagggttttcccagtcacgacggtttaaacgcctccctggtattcagaca

SEQ ID NO: 482 - DNA, 68 bp, Artificial Sequence
  Synthetic Construct
gcgctggcaacgagagcagagcagcagtagtcgatgctaggcggccgcgacgccagaaagaaatgctc

SEQ ID NO: 483 - DNA, 68 bp, Artificial Sequence
  Synthetic Construct
caaccagccgcagcctcagcctctctcagcctcatcagccgcggccgcgacctggtcagctgctcttt

SEQ ID NO: 484 - DNA, 57 bp, Artificial Sequence
  Synthetic Construct
gcggataacaatttcacacaggaaacagcgtttaaactggaaccacatcgacttcac

SEQ ID NO: 485 - DNA, 20 bp, Artificial Sequence
  Synthetic Construct
aaccaccttgtcaccgtctc

SEQ ID NO: 486 - DNA, 20 bp, Artificial Sequence
  Synthetic Construct
ccatgagcttgaacaggtaa

SEQ ID NO: 487 - DNA, 20 bp, Artificial Sequence
  Synthetic Construct
gtcgtcgaggctgctttatc

SEQ ID NO: 488 - DNA, 19 bp, Artificial Sequence
  Synthetic Construct
catcctcaaggcctcagac

SEQ ID NO: 489 - DNA, 20 bp, Artificial Sequence
  Synthetic Construct
gatctcgaatccgaggacaa

SEQ ID NO: 490 - DNA, 20 bp, Artificial Sequence
  Synthetic Construct
ccggtagcgttagagagacg

SEQ ID NO: 491 - protein, 417 aa, Myceliophthora thermophila
MHLTPALVAATCAVEVCAGVLPRSSSTPTTFGSGTLSLKQVRNPNFVRNGPVQLARIYHKYGVPLPHDLREAVARFRAEIRKRSNGSTETNPETNDVEYLTPVSIGTPPQVLNLDFDTGSSDLWVFSSETRSSDVQGQTIYDPNESSTAQKLQGYSWQISYGDGSSSSGDVYTDAVTVGGLTVPSQAVEVARRVSDEFTSDPNNDGLLGLGFSSINTVQPVPQKTFFDNAKADLDAPIFTADLKASAPGFFNFGYIDHGAYTGEITYMPVDSSDGFWAWTSPGYAVGSGSFKRTTIQGIADTGTSLFLLPSSVVSAYYGQISGAKYDSIQGGYTLPCSGSVPDFAFGIGDSNTTISVPGDYVRYAATDSSGIICFGGIQANTGIGFSIFGDVALKAAFVVFDGAKQQLGWASKPLPS

SEQ ID NO: 492 - protein, 396 aa, Penicillium chrysogenum
MVVFSKVTASLACFSAVVSAAAVPVKSPRQGFSVNQVQKTVTGTRTVNLPGVYANALAKYGATVPANVHAAAVSGSAITTPEENDVEYLTPVKIGESTLNLDFDTGSADLWVFSTELSSAEQSGHDVYDVSSSGKKLTGASWSISYGDGSGASGDVYKDTVTVGGVKATGQAVEAAKKISQQFVQDKSNDGLLGLAFSSINTVSPKPQTTFFDTVKSDLDKPLFAVTLKHGAPGTYDFGYIDKKKFTGSLTYTDVDNSQGFWSFTADSYKVGTGSAGPSIEGIADTGTTLLLLDDGVVSDYYKKVDGAKNNYSAGGYVFPCDADLPDFTVTIGSYDAVVPGKHIKYAPVTTGSSSCFGGIQSNSGIGFSIFGDIFLKSQYVVFDAEGPRLGFAAQA

SEQ ID NO: 493 - protein, 394 aa, Aspergillus niger
MVVFSKTAALVLGLSSAVSAAPAPTRKGFTINQIARPANKTRTINLPGMYARSLAKFGGTVPQSVKEAASKGSAVTTPQNNDEEYLTPVTVGKSTLHLDFDTGSADLWVFSDELPSSEQTGHDLYTPSSSATKLSGYTWDISYGDGSSASGDVYRDTVTVGGVTTNKQAVEAASKISSEFVQDTANDGLLGLAFSSINTVQPKAQTTFFDTVKSQLDSPLFAVQLKHDAPGVYDFGYIDDSKYTGSITYTDADSSQGYWGFSTDGYSIGDGSSSSSGFSAIADTGTTLILLDDEIVSAYYEQVSGAQESEEAGGYVFSCSTNPPDFTVVIGDYKAVVPGKYINYAPISTGSSTCFGGIQSNSGLGLSILGDVFLKSQYVVFNSEGPKLGFAAQA

SEQ ID NO: 494 - protein, 386 aa, Aspergillus nidulans
MVVFSKVAAAAFGLSAVASAMPAAPPRQGFTINQLTRAIPKRTINLPAIYANALSKYGGNVPPHIQDAMAHGSAVTTPEQYDVEYLTPVAVGGTTMNLDFDTGSADLWVFSNELPSSQTTGHSVYKPSDNGTRMSGYSWEISYGDGSSAGGDVYRDTVTVGGVTAPGQAVEAASHISEQFTRDQNNDGLLGLAFSSINTVQPKSQTTFFDSVKSQLESPLFAVTLKHQAPGSYDFGYIDQSKYTGELTYTDVDNSQGFWMFSATAGETDFDAIADTGTTLIMIDQSIAEDYYSQVPLAFNNFFYGGWTFPCSAELPSFTVTINGYDAVVPGEHIKYAPVTDGSSTCFGGIQDNQGLPFSILGDVFLKSQYVVFDSEGPQLGFAPQA

SEQ ID NO: 495 - protein, 434 aa, Neurospora crassa
MLLFPTILTAALAATGMAAAIPSRDDTTANKGTASLLQVRNPSFEFRHGPLALAKAYQKFGAPMPEDLRAAIARFRQNQKRTTGTIATDPEKHDVEYLTPISVGTPSQDLVVDFDTGSSDLWVFSTEMSTSDIKGQTVYDPNNSSTSEKVQGSTWKITYGDGSSSSGDVYLDTVTIGNLTVPSQAVEAAKKVSSEFTDDSHNDGLLGLGFSAINAVEPTPQNTFFDNIKGSLDAPLFTVDLKHGTPGSFNFGYIDPAAYIGNISWTPVDSSQGYWGFTSPGYAVGTGAFRNHSISGIADTGTTLLLLPKSVVSAYYKEIQGAQYDSDQGGYIFPCSPTPPDFVFGVNKGIVTVPGDMVSYAPADSANQNCFGGIQTDTGIGFSIFGDVALKTSFVHLHGSIVPGYYADCAMRFNRMLRSYSNDQLVDFSSSGPL

SEQ ID NO: 496 - protein, 466 aa, Myceliophthora thermophila
MDALFETHAKLRKRMALYRVRAVPNQNYQRDGTKSYVSVLNRFGFQPTKPGPYFQIFEESEEAPSMSAAPGVKPGHVWQGLFKKLKDQEEPGEVTAEDQQNDSEYLCEVMIGTAWTAERQIVKMDFDTGLADFWVSQKSFDPKKSVTWQLAKDKSWKVQYGDGSSASGIVGHDILIIGGIQIKRQAIEIATEMSAQFSEGTMDGILGLAFSKLNTVQTDGKPDPQRTVVDNMMAQDDIPPEAELFSTALYSNREDDQRSFYTFGWIDEDLVKASGEEIVWTDVDNSEGFWMFSSEHVTIDGQQVRIEGNKAIADTGTSLVLVSDQVCDALYAHIPSAEYSEEYQGWTFPQETEVDKLPEFSIAIGDKEFVLQKEDLIFAPADERVFYGSVQSRGENPFDILGIAFLKSIYAIWDQGHKRFGAVPKMEAFVPPTKYDRPRLTDQDRKDLGVTIGYGDISSTFFEKRA

SEQ ID NO: 497 - protein, 419 aa, Penicillium chrysogenum
MTRIKLIANPHYQKSGTKSYLYAMRKYRFTPTKDGPYFLGTTMVQTGRQFTNKPVGGRARLQQVLQKKDAVSDEVGQVGVHDVQNDSMYLAEIGIGTPAQTLNLDFDTGSADLWVWSTELSSKILSANKNHRVFDPTKSSTFEEKDGSTWQIKYGDGSFASGTVGNDNVTIGGLVVKGQAVGIADILSEQFAQGAGDGLLGLAFSNINTVKPEAVAMPVENMISQADIPKSAELFTAKLGSWRDTDEPDKGESFYTFGYVDQDTVKAAESEIYYTPVDNSQGFWMFDSTSATVNGKSIARAGNKAIADTGTTLALVDDETCQAVYDAIPGAKYDNASQGWIFPSNTPADKLPVVSFAVGEKQFVVQKEDLGFAEAKSGYVYGGIQSRGTMTMDILGDTFLKAIYAVSDMLFFGVHSCTN

SEQ ID NO: 498 - protein, 420 aa, Aspergillus oryzae
MASKIFLIENPNYCKSGIKSYVHLIRKYRLHPTKNGPYSIGRAIHQTGRPFTDKPIGGRVRFHDVMRKQTSDDQLQQVEKDDIQNDAAFFMPVSIGTPAQTFNLVLDTASVDFWVRSSELPADTLPKGEEESHTFDPEKSSTFKNIEDSPWKVTYVDGSSVSGSIGTEDITIGGVAFKTQPVQLAKTMSPMFTQFSADGVLGLAFGHINHPQQDIKALAERLNTRDDREQSAKLFTAKFGSWGDSDLKKSFCTFGSIDEDAVRYCGHDVHHTPIDNSRGYWMFESPSATVGGKPMSRSENKAVVDTDAALTLLDDQTCQAIYDSIPGAFYDSETQGFLIPSDINVDQLPVVQLAVGEKSFAMSKESLMFAEAKPGYIYGGVQSRGSLEFDVLGGTFLDGLYAIFDFGSLRFGAVQAKTKV

SEQ ID NO: 499 - protein, 397 aa, Myceliophthora thermophila
MKDAFLLTAAVLLGSAQGAVHKMKLQKIPLSEQLEAVPINTQLEHLGQKYMGLRPRESQADAIFKGMVADVKGNHPIPISNFMNAQYFSEITIGTPPQSFKVVLDTGSSNLWVPSVECGSIACYLHSKYDSSASSTYKKNGTSFEIRYGSGSLSGFVSQDTVSIGDITIQGQDFAEATSEPGLAFAFGRFDGILGLGYDRISVNGIVPPFYKMVEQKLIDEPVFAFYLADTNGQSEVVFGGVDHDKYKGKITTIPLRRKAYWEVDFDAISYGDDTAELENTGIILDTGTSLIALPSQLAEMLNAQIGAKKSYTGQYTIDCNKRDSLKDVTFNLAGYNFTLGPYDYVLEVQGSCISTFMGMDFPAPTGPLAILGDAFLRRYYSIYDLGADTVGLAEAK

SEQ ID NO: 500 - protein, 398 aa, Penicillium chrysogenum
MKSFTLLTASALLGSAAAEVHRLKLNKVPLAEQLNTHNIDAHVHNLGQKYMGIRPEKHQDLFHDTSFNPAAGHDVLVDNFLNAQYFSEISIGTPPQTFKVVLDTGSSNLWVPSSQCSSIACFLHSKYDSSSSSTYEKNGTEFEIRYGSGSLSGFVSRDTLQIGDLKVKGQDFAEATNEPGLAFAFGRFDGILGLGYDTISVNKMVPPFYHMINQKLVDEPVFAFYLGDANKDGDNSVATFGGIDESHYTGELIKIPLRRKAYWEVELNSIALGDNVAELENTGVILDTGTSLIALPSTMAELLNKEIGATKGFTGQYSVECDKRDSLPDLTFTLGGHKFTIGPYDYVLEVQGSCISSFMGMDFPEPVGPLAILGDAFLRRWYSVYDVGNNAVGLAKAK

SEQ ID NO: 501 - protein, 397 aa, Aspergillus oryzae
MKSTLVTASVLLGCASAEVHKLKLNKVPVSEQFNLHNIDTHVQALGQKYMGIRPNIKQDLLNENPINDMGRHDVLVDNFLNAQYFSEIEIGTPPQKFKVVLDTGSSNLWVPSSECGSIACYLHNKYDSSSSSTYQKNGSEFAIKYGSGSLSGFVSQDTLKIGDLKVKDQLFAEATSEPGLAFAFGRFDGILGLGFDTISVNKIPPPFYSMLDQGLLDEPVFAFYLGDTNKEGDDSVATFGGVDKDHYTGELVKIPLRRKAYWEVDLDAIALGDSVAELDNTGVILDTGTSLIALPTTLAELINKEIGAKKGFTGQYSVDCDKRDSLPDLTFTLSGYNFTIGPYDYTLEVQGSCISAFMGMDFPEPVGPLAILGDAFLRKWYSVYDLGNGAVGLAKAK

SEQ ID NO: 502 - protein, 394 aa, Aspergillus nidulans
MKASLLTASVLLGYASAEVHKLKLNKVPLTEQFITRNIADHANALGQKYMGQFQQHVLEDEPVNAMRGHDVLVDNFMNAQYFSEIQLGTPPQTFKVVLDTGSSNLWVPSSECGSIACYLHQKFDSSASSTYKKNGSEFAIKYGSGSLSGFVSRDNLQIGDLKVKGQDFAEATSEPGLAFAFGRFDGILGLGFDTISVNRIVPPFYNMIHQGLLDEPVFAFYLGDANKDGDSSVATFGGIDKDHYEGELIKIPLRRKAYWEVDLDAIALGDEVAELENTGVILDTGTSLIALPSNLAEMINTEIGATKGFTGQYTIDCAKRDSLPDLTFTLTGHNFTIGPYDYTLEVQGSCISAFMGMDFPEPVGPLAILGDAFLRKWYSVYDLGNGAVGLAKAK

SEQ ID NO: 503 - protein, 454 aa, Myceliophthora thermophila
MKFAALALAASLVAAAPRVVKVDPSDIKPRRLGGTKFKLGQIHNDLFRQHGRGPRALAKAYEKYNIELPPNLLEVVQRILKDLGIEPHSKKIPGSKSSYGNGAPYTNETDDSGEVSAIPQLFDVEYLAPVQIGTPPQTLMLNFDTGSSDLWVFSSETPSRQQNGQKIYKIEESSTARRLSNHTWSIQYGDGSRSAGNVYLDTVSVGGVNVFNQAVESATFVSSSFVTDAASSGLLGLGFDSINTVKPTKQKTFISNALESLEMGLFTANLKKAEPGNYNFGFIDETEFVGPLSFIDVDSTDGFWQFDATGYSIQLPEPSGNITGTPFRAVAHTAIADTGTTLLLLPPGIAQAYYWQVQGARQAPEVGGWVMPCNASMPDLTLHIGTYKAVIPGELIPYAPVDTDDMDTATVCYGGIQSASGMPFAIYGDIFFKAQFTVFDVENLKLGFAPKPEL

SEQ ID NO: 504 - protein, 545 aa, Aspergillus nidulans
MSVLLVFSLVTFALQGLCSLSLHESDSPHVLQLGLRRNQHNDPVGRDRRRFKRQTGTVAVDLHGDSMGGDIYSTNLTIGDPPQAVEVSVDTGSADLWVVYSENPVCNVRGARCDDSGTYDPTASTSFDGLSDEFAIEYGDSSWAEGYYGIDTLTVADAEVSEVQFAVAVESSIDKGILGIGYSTNVVSTYRYPNLPERLVASNITSSNAYSLWLNRLGSDEGTILFGGVNTAHYTGPLRTLPVVRYNGHYIHLWLTLTGMGVESASDDITKSYSETRSTTGEQEFPFVALLDSGATLTYLPSNIVAQIFSDLDVHLYEPEQFGYVPCDTYLVGREDYNLTFTFSGVTIRVPLRELVLRDAISGPGRDALQLPNNADEESCLFGILPNTDLFPILGDTFLRSAYVVFDLDNNEISLAQANTAPGDDRILEIGSGDDAVPEAEDVDDPVTTATVSLGGSSLILPTGWTNEPIFPSRTVTTSTTATSTGTNTGSGEDTEATDSDQGTSGGTGTQAEGPVATDGAVGVGNSPLLAIAMAALVLNMVLAL

SEQ ID NO: 505 - protein, 410 aa, Aspergillus niger
MKSTTLLSLAWATQSAYSLSIHERDEPATLQFNFERRQIADRSRRKRSTASADLVNLATNLGYTMNLTLGTPGQEVSVTLDTGSSDLWVNGANSSVCPCTDYGSYNSSASSTYTFVNDEFYIQYVDGSEATGDYVNDTLKFSNVTLTNFQFAVAYDGDSEEGVLGIGYASNEASQATVGGGEYTNFPEALVDQGAINWPAYSLWLDDLDEGKGTILFGGVNTAKYYGSLQTLPIVSIEDMYVEFAVNLTAVHLEKNGNSVSVNNSATQFPIPAVLDSGTALTYIPTSAAASIYEAVGAQYLSEYGYGVIECGVKDEDFTFLFDFGSFNMSVDISEMILEASSDMTDMNVCTFGLAVIENEALLGDTFLRSAYVVYDLGNNEISLAKANFNPGEDHVLEIGTGSDAVPKAT

SEQ ID NO: 506 - protein, 486 aa, Aspergillus oryzae
MMRGASLLPVALAALSCVDALSLHRRDTPATVELPIERRQHAGGLQKRDSTLNLPLINYYDSFYILNLTLGTPAQQFAVALDTGSSDLWVNVANSSYCSSRTNPCKPFGLYDPDASSTYKNLGVEFNATYGDGTNAYGYYATDELGLGDVNVDDMQFGVAESTTITQGIVGVAYDTLTNEASHEGKTYVNLPQALVNSGAIKSPAYSLWLNDPQASRGSILFGGVNKAKYKGELQTIPIVRTLRGYSYLAVTLTGVSVEQGKESEDYSSRLPIVVLLDSGTSLTYLPDSLVDELYKTFNATFLEDDGLAYVDCELMKKDYTVNFDFSGATIAVGISELVLKAVAEDFPLGTCAFGVVPSGDSQDAMYILGDTFLRSAYVVYDLGNNEISLANTNFSPGDDDILEIGTGTSAVPGATPVESPVTSATVASATDIVHTVMVGGTKATATDSNSGAAETSSSSGIAALPTSNTRHLLSGLAGAGLLLAL

SEQ ID NO: 507 - protein, 488 aa, Trichoderma reesei
MRASPLAVAGVALASAAQAQVVQFDIEKRHAPRLSRRDGTIDGTLSNQRVQGGYFINVQVGSPGQNITLQLDTGSSDVWVPSSTAAICTQVSERNPGCQFGSFNPDDSDTFDEVGQGLFDITYVDGSSSKGDYFQDNFQINGVTVKNLTMGLGLSSSIPNGLIGVGYMNDEASVSTTRSTYPNLPIVLQQQKLINSVAFSLWLNDLDASTGSILFGGIDTEKYHGDLTSIDIISPNGGKTFTEFAVNLYSVQATSPSGTDTLSTSEDTLIAVLDSGTTLTYLPQDMAEEAWNEVGAEYSNELGLAVVPCSVGNTNGFFSFTFAGTDGPTINVTLSELVLDLFSGGPAPRFSSGPNKGQSICEFGIQNGTGSPFLLGDTFLRSAFVVYDLVNNQIAIAPTNFNSTRTNVVAFASSGAPIPSATAAPNQSRTGHSSSTHSGLSAASGFHDGDDENAGSLTSVFSGPGMAVVGMTICYTLLGSAIFGIGWL

SEQ ID NO: 508 - protein, 488 aa, Trichoderma virens
MKASPLAVAGVVLASAAQAQVVQFDIEKRHAPSLRRRDATIDATLSNEKVQGGYFINVQVGTPGQNITLQLDTGSSDVWVPASTAAICTEVSQQNPGCTFGSFNPDDSSTFQVVGQNLFDITYVDGSSSKGDYIQDNFQINGLTVKNLTMGLGLDTSISNGLVGVGYINDEASLGTTRSTYPNLPVVLQQEKLINTVAFSLWLNDLDASTGSILFGGIDTEKYQGELTRINIISPDGGKTFTEFAVNLYSVQASSQSGTDTLSTSENTLVAVLDSGTTLTYLPQDMAEEAWNEVGATFSSELGLAVVPCSVGNKNGHFSFKFAGADGPTVNVTLSELVLDLFSGGPPPQFSSGPNKGQSICEFGIQNTTDAPYLLGDTFLRSAFVTYDLVNNQIGIAPTNFNSTQTNIVAFASSGAPIPSSTAAPNQSNTGHSSSTQSGLSAASGFQDGGNDNAAPLTSAFSGPGMFVVGMTICYTLLGSAVFSFRWL

SEQ ID NO: 509 - protein, 488 aa, Trichoderma atraviride
MKASPLAAAGVALASTAQAQVVQFDIQKRDGPNLRDLGRRAATINGVLSNQQIQGGYFLNVEVGTPPQNITLQLDTGSSDVWVPSSSADICTQVSQRNPGCTFGSFDSDKSTSLRTVGKDEFDITYVDNSFSKGDYIQDDFHIGGVTVSNLTMGLGLDSSIANGLIGVGYINDEASLSTIRSTYPNLPVVLQQEKLINTVAYSLWLNDLDASAGSILFGGIDTEKYQGDLTKINIQRADNSNVFTEFAVELFEVQATSPSGTDTLSTSVDSLVAVLDSGTTLTYLPQDMAEQAWKEVGASFNEEFGLAVVPCSIRNVNGHFSFTFAGADGPKINVTMAELALDLFSGGPQPKFSSGPNQGQSVCEFGIQNTTGSPFLLGDTFLRSAFVVYDLVNNEIAIAPTNFNSTKTNVVAFASSGAPIPSATSAPNQSKSGPSSGTGGMSAASGFQDSDNAAPYTSAFSGPGAIIVGMTIGYTLLGGAIFGAGWL

SEQ ID NO: 510 - protein, 504 aa, Neurospora tetrasperma
MKGYTSSALLLGPALLSQLALAQQAPSGVVHWGIQKRHAPNAPNRLLRRAGPTHQAILQNEQARGGYFATCEMGTPGQKVTLQLDTGSSDVWVPDSTASICNKGACDLGSFDPSKSETYTVVGQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLDADEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIALAETDFNSTESNIVAFASMSATIPSATQAPNQAAVTNRPVATMPSFAASSGFSDTGGSGNDGKDENASAGMPSAFGVAQMSVMGIAMVFAMIGSGVFVLL

SEQ ID NO: 511 - protein, 501 aa, Myceliophthora thermophila
MRGYAAVAFGAILAGAVHASAGNGVVQWDIRRTQRQEELQRLNRRLRKRANPVLEVITNEKIRGGYFATCKIGTPGQDLTLQLDTGSSDIWVPDSAAQVCREIGTEGCALGTFNPNRSSSFEVIGEGQFDIEYVDGSSSKGDYFTDVFQIGDISVQNMTMGLGLHTDIAYGLVGVGYAINEAIVATTQSRDSVYPNLPVQMVDQGLINTVAYSLWLNDLDASSGSILFGGIDTEKYQGELTRIDIYPTSQGDFSSFVVALTSLEARSPSGQDTLTSQEFPIPVVLDSGTTLSYLPTDLATQAWKEVGAFYLPEVGAAVLPCDMENSKGSFSFGFAGPDGPRITVGMDELVLDMTDGQAPQFLSGPYKGRDVCQFGIQNFTSAPFLLGDTFLRSAYVVYDLVNNQIGIAATDFNSTDSNIVPFPSMGAPIPSATVAANQREVTRVPTVTEPAYSASQGFMESASGEESLAPGMPAAWGMGQLLVVGVTMALTALGSGLFFVL

SEQ ID NO: 512 - protein, 492 aa, Neurospora crassa
MKGYTSSALLLGPALLSQLALAQQAPNGVVHWGIQKRHAPNAPNRLLRRAGPTHQAILQNEQARGGYFATCAMGTPGQKVTLQLDTGSSDVWVPDSTASICNKGACDLGSWQGEFDISYVDGSSSKGDYFTDVFNIGGTTVTNLTMGLGAQTDIAYGLVGIGYAINEAIVGNSHSLSSQYPNLPVAMVDDGLINTIAYSLWLNDLDAGEGSILFGGIDTKKYKGDLTRIRIYPSSNGYYFSFIVALTSLQAISPSGNDTLTSQEFPIPVVLDSGTTLSYLPQDIVDQIWQEVGAEYSDRLELAVIPCSKKSSNGYFSFGFAGPDGPRITVRMDELVLDLTSGDPPKYTSGPNKGQDVCEFGIQNSTSAPYLLGDTFLRSAYVVYDLVNNEIGLAETDFNSTESNIVAFASMSATIPSATQAPNQAAVTNRPVATMPSFAASSGFSDTGGSGNDGKDENASAGMPSAFGVAQMSVMGIAMVFAMVGSGVFVLL

SEQ ID NO: 513 - protein, 484 aa, Metarhizium anisopliae
MKYSSAVDACVSSVIILAPAVFGQVVRWDIQKHYQASGLRRRAGTLQSDASNNKAQGGYFVAVQIGTPGQELSLQLDTGSSDVWVPSSQAPVCLDKAQGGCPLGSFDFDQSGTFDVIVANGFDISYQDNSSASGDYFADKLEIGSKSLNNFTMGLGKKTDVPFGLIGVGYAGNEASTETANAIYPNLPIAMQEAGIINSVAYSLWLNDLGASTGNILFGGIDTEKYVGHLTKLPIQPENQQFTHFIVSLFSLEATSPSGNDVLTSRELPLKVVLDSGTTLSYLPPDMAAQVWSEVGATYDDMSFQTAIIPCSYASHAGHFSFVFSGPDGPRINVTMDELVLPLTDGEPPTFSSGPHSGQTICEFGIQKSSDTPWLLGDTFLRSAYVVYDLMNNEVGIAPTDFNSTKSNVIAFASKGAAIPSATSVNNGSKSGIQSQPTQTGLSAAKGFQEGSLACSLESLSVFSLTFISMTITALLMGSPIFTD

SEQ ID NO: 514 - protein, 507 aa, Thielavia terrestris
MKGHSAAALGALLVGVVHPVAANGVVQWDIRRSQRSQEFTKLRRRGSTFNEVISNDEARGGYFATCQIGTPGQNLTLQLDTGSSDIWVPDSKASVCRKFGNSGGCNLGAFDSAQSSSFEVVGKGEFDISYVDGSSSKGDYFTDVFSIGGATLQNMTMGLGLETDISYGLVGVGYAVNEAIVGSSQSVSSAYPNLPVNMVNEGLINTVAYSLWLNDLDASSGSILFGGIDTKKYKGDLTRIQIYPATQDIFTSFKVALTSLEAISPSGQDTLTSTAFPIAVVLDSGTTLSYLPTDLAMQIWKEAGAEYSAHYGTAIIPCSMQNSQGYFSFGFAGPGGPRINVTMDELVLDVSTDGGPQFTSGQYKGETICEFGIQNISSSPYLLGDTFLRSAYVVYDLVNNEVGIAQTDFNSTESNVVAFASMSATIPSATVAPSQAEVTNRPTVTVPAYAASKGFTDLSASGTAASTSAEQNAATPTPSRASTGQMLVVSLTMLLTAVGSGLFVAIL

SEQ ID NO: 515 - protein, 494 aa, Fusarium oxysporum
MKSSLVGASLVSTLGLVQAQTIQWNIEGRHPQPHLARRAKTTYEEVISNDRSEGGYFTEVTIGNPPQNITLQLDTGSSDVWVPWNCADICEDDKNGKSGCPLGSFDPDKSKTFKHVAPGMFGITFVDDSYVKGDYFEDHFELDGAVINNLTMGLAIKTNISYGLIGVGYAKNEASGSTTDVIYPNLPVAMYQAGYINTIAYSVWLNDLDAKAGSILFGGVDTAKYVGDMHRIDIQKLDGHYYHFVVALTSLVATSSSGSDVLTSDSFPIQAVLDSGTTLSYLPQDLAHEIWEEVGAVWSPYYGVAVLPCAYGRNQGNFTFGFAGPDGPSISVGMDELVLSMTSDAANMPVFESGAYKGENICTFGIQNDTNDLYLLGNTFLRSAYVVYDLVNNEVGIAATDFNSTKSKRVPFKSYGATIPSATASSNQHRATEKPTVPGHNFTAAEGFQESDSNGNGDKDNAGSLLNPPTTPLALVVTTMSFMLAGGGIFSSIF

SEQ ID NO: 516 - protein, 492 aa, Gibberella zeae
MKSWLWGASLVSTWGLVYAQTVQWSIEGRHPQPQLARRTKTTYEEVISNDRSEGGYFTEVTIGSPPQKVTLQLDTGSSDVWVPWNCADVCTDNDNGKGGCPLGSFDPDKSKSFKHVAPGMFGITFVDNSYVKGDYFEDHFELDGAVINNLTMGLAVKTNISYGLIGVGYAKNEASGSTTDVIYPNLPVAMYEAGYVNTIAYSVWLNDLDAKAGTVLFGGVDTAKYVGDMHRIDIQKVDGHYYHFVVALTSLVATSSSGSDNLTSECFPIPAVLDSGTTLSYLPHDLATEIWQEVGAVWSPYYGVAVLPCAYGRNNGNFTFGFAGPDGPVISVGMDELVLTMASDRANMPVFQSGPYKGHTMCSFGIQNDTSDLYLLGNTFLRSAYVVYDLVNNEVGIAATDFNSTATKRVAFKSYGASIPSATAVANQHKATENPSVSGHNFTAADGFQESDWDSDDEDNAAISLTPSGTPLVMAVVTMGFVLLGGGIFHTF

SEQ ID NO: 517 - protein, 484 aa, Magnaporthe oryzae
MLGISALLIVCASLGSFAAASDGVVQWHIERRQVPTPTAKLAKRVATTFEEVIQNEKSRGGYFAKCSVGGQDVTLQLDTGSSDLWVPAESACQSDRVPNGCSLGSFKKDLSSSFKVTGKDQFSIQYIDGSFARGDYFTDAFSIGGVRVINLTMGLGKQTDIPYGLAGVGYALNEAIVGGNSSNFTTYPNLPATMLNDGLINTNAFSLWLNNLDASTGRILFGGVDVAKFKGGMARIRIYEDVFSQEYMSFTVALTSLEAHSGSGQDTLTSRSFPIPVVLDSGTTLSYLPNDLAVQTWTEVGALYSAEYGQALLPCAMEDSKGYFVFGFAGPDGPKIQVEMKELVLDLTNGPAPKFTNGKYQGQDACTFGIQNFTGQTMVLGDTFLRSAYVVYDLVNHEIGIAQTDFNSTTSEIIAFPSSGAPIPSATLAPNQDQAVVKPQVTIPAFNAQPGFREGVSQATPLLKPLNKTHILLMCAAIALIMSG

SEQ ID NO: 518 - protein, 474 aa, Penicillium chrysogenum
MKHAWILLVGLVPAWGLTLHRRDNPAVVQMDIQRKDVLDPITRDRRRKRSTVRQPLDNEETLYFCNVTLGTPEQKVRLVLDTGSSDLWCNTPNSTLCESSENACASGTYDSSSSSSYSFVSSDFNISYADGSGAAGDYVTDTLTIGGTTIKDFQFGIGFSSGSPEGVLGIGYTANEVQVGRNGESAYANLPQAMVNKGVIKSNAYSLWLNDLDANTGSILFGGVNTKKYHGALQTVPIQKVGGRYSEFIIALTEVSLTTSSGQNTYSSSSIPAGVLLDSGSSLTYLPDALVQEIYDDLGVSYESDSGIGYVECSMAEQSILSYTFSSPTINVGIDEMIIDVGDLYFRNGKRACIFGIVPAGTSTAVLGDTFLRSAYVVYDLENNEISLASTNFNSTENDILEIGTGTDSVPGATAVSNPVTTAPVGGTAARIGGPHGGSDLSGSATVNMAIPKATAMPRHMAVGLAGVGALLAL

SEQ ID NO: 519 - protein, 487 aa, Aspergillus oryzae
MQKSWLVLLVACLGLQGTTALTLHRRDLPAVVSLDIKRNNAVDPVARDRMRRKRDKTVEQNLDNEETLYFCNITLGTPKQSLRLVLDTGSSDLWCNAANSTLCSSRDQPCNASGSYDPSSSSSYAYTSSDFNISYADGTGAAGDYVTDTIHIGGATVKDFQFGVGYSSSSAEGVLGIGYTTNEVQVGRLGKSAYANLPQAMVKNGLIQSNAYSLWLNDLGADTGSILFGGVNTEKYHGELQTLPIQTVNGVYSEFIIALTGVSLSSASSHHNYSSSDALPAAVLLDSGSSLTYLPNSIVQDIYDDLGVTYESSSGVGYVPCSLAQQNINVTYTFSSPIITVGIDELVLDAGDLRFRNGARACIFGIVPAGDSTAVLGDTFLRSAYVVYDLSNNEISLANTKFNSTKDNILEIGTGDDSVPGATQVSNPVTSVVADGSGARIGGPTGEIFTDIPSATSSGGAAAPAGPTDVPKHLVLGAAAIGYVLAF

SEQ ID NO: 520 - protein, 454 aa, Aspergillus nidulans
MLRVGFDASTNEIPDPVARDRRRRKRDQTVAQLIDNEETLYFCNLTVGTPGQSLRLILDTGSSDLWCNAANSTLCSSPKDPCRISGSFDPSSSSSYSYISSDFNITYADGTGAAGDYATDTVSIGGATIKDFQFGIGYTSSSAEGVLGIGYPSNEVQVARYGDDAYPNLPRFLMQNGFVQSSAYSLWLNDLEANTGSILFGGVDTEKYRGDLQTLPIQTVNGEYSELIIALTGVSLDTEARKHTVSSNALPAAVLLDSGSSLSYLPDSIAEKIYDDLRISYEPSTGAGYAPCSLARQNINVTFTFSSPEIAVGIDELIIDAGDLRFSNGERACIFGLVPAGDNTAVLGDTFLRSAYVVYDLTNNEISIAKTNFNSTKSNILEIGTGSDAVPGATKVSHPVTSVVADGSGSRIGAPTNTEDIVPSASTGAAVVLGRSTISPVLVGAAALGYMFAF

SEQ ID NO: 521 - protein, 486 aa, Aspergillus niger
MWRVLSLLVAVSFVPLETAKALVLQRREVPAVVTLDIKRNDVSDPVMRDRARRRRDTTTVAQALDNEETLYFCNITLGTPEQSLRLVLDTGSSDLWCNAANSTLCSSSTDPCSTSGTFNSDKSTTYTYVSSDFNISYADGTGAAGVYATDTLHIGASTLEDFQFGIGYTSSSSEGVLGIGYTSNEVQVGRFGDSAYPNLPRAMVKSGLIKSNAYSLWLNDLDANTGSILFGGVNTKKYHGELQTLPIQKVNGIYSEFIIALTGVAFTSGSSSRNYSSDALPAAVLLDSGSSLTYLPDSIVEDIYNDFDVVYEQSSGVGYVPCSLAQNNTNITYTFSSPTITVGVNELVLDVGDLLFQDGERACVFGIVPAGDSTAVLGDTFLRSAYVVYDLANNEISLANTNFDATGNDVLEIGTGEDSVPGATKVANPVTTVAVDGSGARIGGPTGATFTSIPSATSGGHATARFMGATRLLAFGAAVIGYMLTF

SEQ ID NO: 522 - protein, 761 aa, Trichoderma reesei
MRSTLYGLAALPLAAQALEFIDDTVAQQNGIMRYTLTTTKGATSKHLHRRQDSADLMSQQTGYFYSIQLEIGTPPQAVSVNFDTGSSELWVNPVCSKATDPAFCKTFGQYNHSTTFVDAKAPGGIKYGTGFVDFNYGYDYVQLGSLRINQQVFGVATDSEFASVGILGAGPDLSGWTSPYPFVIDNLVKQGFIKSRAFSLDIRGLDSDRGSVTYGGIDIKKFSGPLAKKPIIPAAQSPDGYTRYWVHMDGMSITKEDGSKFEIFDKPNGQPVLLDSGYTVSTLPGPLMDKILEAFPSARLESTSGDYIVDCDIIDTPGRVNFKFGNVVVDVEYKDFIWQQPDLGICKLGVSQDDNFPVLGDTFLRAAYVVFDWDNQEVHIAANEDCGDELIPIGSGPDAIPASAIGKCSPSVKTDTTTSVAETTATSAAASTSELAATTSEAATTSSEAATTSAAAETTSVPLNTAPATTGLLPTTSHRFSNGTAPYPIPSLSSVAAAAGSSTVPSESSTGAAAAGTTSAATGSGSGSGSGDATTASATYTSTFTTTNVYTVTSCPPSVTNCPVGHVTTEVVVAYTTWCPVENGPHPTAPPKPAAPEITATFTLPNTYTCSQGKNTCSNPKTAPNVIVVTPIVTQTAPVVIPGIAAPTPTPSVAASSPASPSVVPSPTAPVATSPAQSAYYPPPPPPEHAVSTPVANPPAVTPAPAPFPSGGLTTVIAPGSTGVPSQPAQSGLPPVPAGAAGFRAPAAVALLAGAVAAALL

SEQ ID NO: 523 - protein, 546 aa, Trichoderma virens
MRSTLYALAAWPLAAQALDFIDSYTSEQNGIMRYTLTTTKGARSKHLHRRQDSADLQSQQTGYFYSIQLEIGTPPQAVSVNFDTGSSELWVNPVCSKATDPAFCETFGRYSNSTTFVDTQAPGGIKYGTGFVDFTYGYDYVQLGSLRINQQVFGVATDSEFASVGILGAGPDLSGWKSPYPFVIDNLAKQGFIQSRAFSLDIRGIDSDRGSVTYGGIDVKKFSGPLAKRPIIPAASSPDGYTRYWVYMDGMSITKEDGSDLEIFDKPNGQPVLLDSGYTVSTLPGPLFEKILLAFPSARLESSSGDYIVDCDIIDSPGRVNFKFGDVVVDVEYKDFIWQQPDLGICKLGVSQDDQFPVLGDTFLRAAYVVFDWDNQNIHIAANEDCGTELIPIGSGPDAIPASAIGQCSSSVNKTTTSAVQTTTSAAASTSKLATTSAVATTSAAATTSGAASSGHLPTTSHHFGNGTVVYSLPTLSSTSVSEQSTDAAKGTTTAAGAGTTAAPTYTSTFTTTNVYTVTSCPPSVTNCPVGHVTTEIVTSYTTWCP

SEQ ID NO: 524 - protein, 549 aa, Trichoderma atroviride
MRSTLYALAAWPLAAQALEFLDDNKNVEEGGIMRYSLTAAKGARSKHLHRRQDTAELQSQETGYFYSIELEIGTPPQAVSVNFDTGSSELWVNPECSKATDPAFCQSFGRYNASKTFVDTKADGGIKYGTGYVDFVYGYDYVQLGSSRISQQLFGVATDSEFASIGILGAGPNLSGWTSSYPLVIDNLAKQGFINSRAFSLDIRGLDSDRGSVIYGGIDTKKFSGPLVKRPIIPAASSPDGYTRYWIYMDGMTITTEDGSHVEIFNKPNGQPVLLDSGYTVSTLPSSIFTKILAAFPMAHIEASSGDYLVPCDIIDTPGSVNFQFGDATVSVDYKDFIWQQPDLGICKLGVSQDDDFPVLGDTFLRAAYVVFDWDNQNIHVAKNEDCGTHLIPIGKGADAVPSGLKGDCAAAGQTTTSAVQTTSAAASTSARVSTSAAATTTSVAITTTAPATSGLKATTSSHRFANGTVTYSVPHGRTTVISEISSAAATQLDTTTAPASGTTAAPTYTSTFTTTNVYTITSCPPSVTNCPVGHVTTEVVTAYTTWCP

SEQ ID NO: 525 - protein, 811 aa, Fusarium pseudograminearum
MLSTLFLAVAAPALATAFNAPNVPVGTDDSSPDGLIRFPLKVSTGAPVVKGVTKRQNEVALESQQNGFFYSIDVTLGTPGQKVTVNLDTGSAELWVNPVCEKAQQPAFCKQFGHFGESSTFVDLNTTGGVVYGTGYAYWNYGYDNVVVGSAAIRNQVFGVAYDSSFTGVGIMGAGPDLNGWDAPYPLVIDSMVKQGLIKSRALSLDIRTLNSDRGAVIFGGIDTAKYTGRLQKLPIIPAASSPDGLTRYWVNLDGISLVQEDGTVDSAFSGSTPQPVLLDSGYTVSALPGSIFNKIVAAFPTAKSNGGAYVDVDCSVADIKGSVDFKFGDKTIKVPYADFIWHNDERCVLGVFQDDEFPVLGDTFLRAAYVVYDWDNRNVWIANNEDCGTNLVAIGTGPDAVPDLVGQCGSDSETTTSASETASATGTETETETASATESEAVTATTEDVTSAETDTTTGYFPTTRYSNGTVSVTGKGTSTTKKATGGSGESYELPSYTDSSASATITSTVVTSKVYTVTACPPSVTNCPVGHVTTETITSLTTYCPGSDGSAPHPTTVEGEGAPHPTGAAHLTSYVTATNMHTVTSCPGEGACHTSVITEIVHNTQIASPEEPTGIFTIPEAIQCGAGNFGCKEATTKGYRTVTITPVVKAPKPTPVPGYCATCGPLKGHGHHNDDDDKETATGGYTAPGKQTGGYDQPTQAHPGQDYPRPTGDSPKPTGGSDKPTGDSDKPSGDAPKPNPLEELQTYRPTNVFPQIPSSVATVVKPTGTPQAGGPSEPAGTPPVVINGASGWNVPVVAAVVVGAFVAAL

SEQ ID NO: 526 - protein, 824 aa, Metarhizium acridum
MMLSSLFSLAALPLATQALAEFPVDNRMVQEPGLIRFPLDIAAGAPTKNRMPKRQNEIGVNAEKSGFFYSIELQVGTPAQAVRVNFDTGSAELWINPVCSKSTDPGFCDKLGRFNGSQTFVDTNTTHEIRYGTGFAKLEYGYDYVQIGSAKISQQMFGVATDSEFASAGILGAAPQLKGWKSDYPLVLDNLAAQGFIKSRAFSLDIRSIASKRGSVVFGGIDTKKFSGHLEKRPIIPATESPDKLTRYWIYLDGVSVTKEDGSKAVIFDQANGQPVLLDSGYTVSALPTRHFNKIKDAFPGVSAPPEDDKSGLYRVPCDVGSKNGSVNFKFGKTEIVVPYDDFIWKQPENNLCVLGVTPDDEFPVLGDTFLRGAYAVYDQDNRNIHLANNEDCGSSLVAIGTGPDAVPSVEGDCGRPEPTTTSTHSKTTLATIPTGNSTISSAKHTTSSSSVVSPTSTHSTTSSAAIPTAHNSSVIPSAKSTASSSSTASLTIPATRNSTVISAKPTTASTLVSTGHEDNTVLTTSKLISTTSKPISITSKSTSTTSNPLPTGTEQNTTVPVTHTSTFTTTSVHTILSCPPYVTGCPIGSVTTETITGVTTWCPGNTAPSAKPPQTTETKTPPPATVITVQPTVTSAPSITSVFTTTKTHAITSCSEQASCNKGHVTTEVVTSTTYLCPESTATFTIPRTHTCREGDNGCRSGDVVTTVFTVTVEPQPTADKPTPVPGCGDNCVLPPPAQTRPAAETTAAETQPSITAIITAPGPVPTVPGTNGTITTTSKPGDTPCSTCSPETTSTPMTAGASGFRIPIMAVAMIVGALTVIL

SEQ ID NO: 527 - protein, 811 aa, Gibberella zeae
MLSTLFLAVAAPALATAFNAPNVPVGTDDSSPDGLIRFPLKVSTGAPVVKGVTKRQNEVALESQQNGFFYSIDVTLGTPGQKVTVNLDTGSAELWVNPVCEKAQQPAFCKQFGHFGESSTFVDLNTTGGVVYGTGYAYWNYGYDNVVVGSAAIRNQVFGVAYDSSFTGVGIMGAGPDLNGWDAPYPLVIDSMVKQGLIKSRALSLDIRTINSDRGAVIFGGIDTAKYTGRLQKLPIIPAASSPDGLTRYWVSLDGISLVQEDGTVDSAFSGSTPQPVLLDSGYTVSALPGSIFNKIVAAFPTAKSNGGAYVDVDCSVADIKGSVDFKFGDKTIKVPYADFIWHNDDRCVLGVFQDDEFPVLGDTFLRAAYVVYDWDNRNVWIANNEDCGTNLVAIGTGPDAVPDLVGQCGSDSETTTSASETASATETETETETASATESEAVTATTEDVTSAETDTTTGYFPTTRYSNSTASVTGKGTSTTKKATGGSGESYELPSYTDSSASTTITSTVVTSKVYTVTACPPSVTNCPVGQVTTETITSLTTYCPGSDDSSSHSTTVEGEGATHPTGAVHLTSYVTATNMHTITSCPGEGACHTSVITEIVHNTQIASPEEPTGIFTIPEAIQCGAGNFGCKEATTKGYRTVTITPVVKAPKPTPVPGYCATCGPLKGHGHHNDDDKETATGGYTAPGKQTGGYDQPTQAHPGQDYPRPTGGDSPKPTGDSHNPTGDSDKPSGDAPKPNPLEELHTYRPTNVFPQIPSSVATVVKPTGTPQAGGPSEPAGTPPVVINGASGWNVPVVAAVVVGAFVAAL

SEQ ID NO: 528 - protein, 668 aa, Myceliophtora thermophila
MSFALYAAALLPVAVLGAGLSVPEDNRMVQQDGLLRYPLMPRLGNLLFGKHANITRRQIDTGIFDPLSGTLYTIELTLGTPGQTVPVQFDTGSDMLWVNPVCSKAAEPEFCAAQPRFTDSSTLVDFGEQGNITYGTGYAYYEYVADYVAIGSARITQQVFGVALDSAHADVGIFGAGPNLDGWDSAYPLVVDSLAQQGYTSSRAFSMDLKGFESARGSVIFGGIDTKKYRGSLIKRLIIPAAESPDGYTRFWIYLDGISVNQPDGDVVTVFSTPDGGKGQPVLLDSGYTLSALPRPIFQKLVAAFPSAQYVSSADVYVVDCVDHGEGGSLDFIFGGKTINVPYHEFVWAQPESNTCVLGAFEDDFPVLGDTFLRSAYVVYDWDNRNIYLAQSDDCGSNLVAIGSGPDAVPSIVGECGKPKPTSTSTFSKTSSKTSTASKTSSTSDSTSSSSSHVTTSSSSTTATTLSTHKPPFPTASGNFTTTRSPTTTTASSTISKSTLTITSATTYTITSCPPTVTRCPAHEVTTEIITKTTAVCPETTATYTIPRTITCPGSGGGDDCPPGATRTTTLTVTLSPVGPTDRTTHVVPGVTTTTPTTITAPPTGQTTTTLVPALPPTTTTMSGHRGINGTVTATSKPPAVTAGSAKVGLVSGATAIVAGVMAVLMAL

SEQ ID NO: 529 - protein, 551 aa, Neurospora crassa
MLPVPLTTLSLYVVALLSPPAAAGVLASATTKLPIKLPISPAQGHRSSTAASPSLTSRSSSSGNGFIRASVHAAHGAPPKLRRRQEDEGLKNQNLGTTYTIDIDIGTPPQTVTLILDTGSPDLWVNPQCETSGQEKYCNSFRQFDYTKSKTIQDTGAADILKYGKGNVTIEYVTDDVIIGSAKIKSQILGIGFESIDIPLGILGLSPSVSPDGTSPYPYLLDSMASQGIISSRAFSLDLRSIDNPSGAIIFGGVDLGKFSGSLAKLPMLDPSQTPAGVDRYWIVLSGVGMTYPDGEEVESEEIGVPVFLDSGGTLSRLPETIFQAIGDSFPGSQYDPESGFYIVDCAVAEQAGSVDFIFGSSGSRSSKKIRVPYGDFVWEVQTGVCVVGVLPTDDEPVFGDSFLRAAYVVFDQDNRNLHLAQAANCGEQIVEIGSGQDAVPSSTGKCKDGSAGSTKTAGGGGLDVTATRAPTRTAGGSGPAVTNSDFGPGPAGTRVSTGGIGLPTGTGGGGGSGDGNGNNDDDDSAASGLDVGVTAAAVLAGLNMLIVWLL

SEQ ID NO: 530 - protein, 477 aa, Trichoderma reesei
MRFVQYVSLAGLFAAATVSAGVVTVPFEKRNLNPDFAPSLLRRDGSVSLDAINNLTGGGYYAQFSVGTPPQKLSFLLDTGSSDTWVNSVTADLCTDEFTQQTVGEYCFRQFNPRRSSSYKASTEVFDITYLDGRRIRGNYFTDTVTINQANITGQKIGLALQSVRGTGILGLGFRENEAADTKYPTVIDNLVSQKVIPVPAFSLYLNDLQTSQGILLFGGVDTDKFHGGLATLPLQSLPPSIAETQDIVMYSVNLDGFSASDVDTPDVSAKAVLDSGSTITLLPDAVVQELFDEYDVLNIQGLPVPFIDCAKANIKDATFNFKFDGKTIKVPIDEMVLNNLAAASDEIMSDPSLSKFFKGWSGVCTFGMGSTKTFGIQSDEFVLLGDTFLRSAYVVYDLQNKQIGIAQATLNSTSSTIVEFKAGSKTIPGPASTGDDSDDSSDDSDEDSAGAALHPTFSIALAGTLFTAVSMMMSVL

SEQ ID NO: 531 - protein, 470 aa, Trichoderma virens
MRSSVQYISLAGLIAAGTVSAGIVSIPLEKRYIINDPAPSLLRRDGSISLDALNNITGGGYYAEFSIGTPPQKLSFLLDTGSSDTWVNSVKADLCTSPSVQQTVGEYCYKQFNPSSSSSYKSSTEDFDIKYLDGRRIQGTYFKDTVTINGASIKSQQLGLALVSVRGTGIMGLGFTDNVAADVKYPTIIDNMVSQNVIPVPAFSLYLNDLQTSQGAILFGGVDTDKFHDGLATLPLQPLPANVATTQEIVMYNVQLNGFTASGVDTPAVNGSAILDSGSTLTLLPDAVAQSLWKKYGVINLQGLPIPFVDCGKANTKDATFNFKFTNKTIKVPIDEMVINNLASIQGEIMSDPTLSSLFKGWSGVCTFGISSTRNYGIRTDNFILLGDTFLRSAYVVYDLQNKQIGIAQATLNSTTSSIVEFQKGSKTIPGPVSTGADDSGSAGSAIYPTFSIALAGTVFTALSMMLSAL

SEQ ID NO: 532 - protein, 480 aa, Trichoderma atroviride
MRSTLQYASLAALVAAGTASAGVVSVPFEKRFLDSNPLPSLLRRDGTVALDALNNITGGGYYAEFSVGTPPQKLSFMLDTGSSDTWVNSVDADLCTDSIIQEEVGEFCSKQFDQTKSKSFNSTRQLFNITYLDGRNIRGRYFKDTVTINNAAIKNQQMGLALESVRGTGLMGLGFRSNEAAAIKYPTVIENMVSQKIIAMPAFSLYLNDLQTSQGSILFGGVDTDKFHGGLATLPFQSLPASVSRTSDIVMYAVQLNGLKVSGVDTPSVNATAVLDSGSTISLLPGDVVQAVWKEFGVMNVQGVPNPFVDCAKANLKDTSLSFQFTNKTIQVPIDEMVINNLASVQDQIFSDPTLKQVFKGWSGVCTFGMASTSDFGISSDQFVLLGDTFLRSAYVVYDLQNQQVGIAQATLNSTSSSIIEFQAGSKSIPGPVSTGSDDSSSDDGDSSGKDNAGVALHPAFSAAIAGTLFVTLSMIMTAL

SEQ ID NO: 533 - protein, 461 aa, Fusarium pseudograminearum
MRTFTILASLTIGASAGTVSAPFVKHGFHYGASIDKRDTLNLEALNNITGGGYYAEFQIGTPPQNISFLLDTGSSDTWVNSNNTDLCHSQAAQKKNGYCMTTFKPENSRTFKVVDRDGFDIRYLDTRRIEGDYFNDTVTIDGKTVKQQQLGLAIKSVRPTGIMGLGFSANVATNKSYPAIVDNMVSQGLIDTATYSLWLNDLDSDQGTILFGGIDTKRFYGKLATLPLLPESTKSLNVTSFSVSLQGLNVKTPKNSNGIKMDSLKKNTVAILDSGSTVCLLPDPQVNEIYKAFDVLSVQDVPIPFVDCGYGKDKGKGISFDFEFDGKTISIPMSEMIVNAFPDNQDLFKDPRLDIYFKDWDGVCMFGISPASTYGIGTSKFAILGDTFLRSAYVVYDLANEQVGIAEAYHSNNESSVVELKANSKLPDVSGVPEPQNAAGHVSPASLVTLIVATGIALTLL

SEQ ID NO: 534 - protein, 482 aa, Gibberella zeae
MRTFTILASLTIGASAGTVSAPLVKHGFHYGASIDKRDTLNLEALNNITGGGYYAEFQIGTPPQNISFLLDTGSSDTWVNSNNTDLCHSQAAQKKNGYCMTTFKPEKSRTFKVVDRDGFDIRYLDTRRIEGDYFNDTVTIDGKTVKQQQLGLAIKSVRPTGIMGLGFSANVATNKSYPAIVDNMVSQGLIDTAAYSLWLNDLDSDQGTILFGGIDTKRFYGKLATLPLLPESTKSLNVTSFSVSLQGLNVKTPKNSNGIKMDSLKKNTVAILDSGSTVCLLPDPQVNEIYKAFDVLSVQDVPIPFADCGYGKDKGKGISFDFEFDGKTISIPMSEMIVNAFPDNQDLFKDPRLDIYFKDWDGVCMFGISPASTYGIGTSKFAILGDTFLRSAYVVYDLANEQVGIAEAYRSNNESSVVELKANSKLPDVSGVPEPESAAGHVSPASLVTLIVAAGITLTLLKDLRHLCYCSYCSPNCYTVPA

SEQ ID NO: 535 - protein, 482 aa, Metarhizium anisopliae
MPSLHHVALVLGAVATVSAGTLSVPLERRGPSEEHYRLLGRAISRRAADNGTAELTALNNITAAGYYANFAIGTPGQNLTFQLDTGSSDTWMNSPQTRYCRSATAQSEAGYCTTTFNPRDSKTYTLVDQGGFNITYLDQRRITGDYFNDTVTIGGHEIANQQLGLAISSTRPTGIMGLGFSINVATPNKYPTIIDNMVSEGVIAHPSFSLYLNDLDATSGTILFGGIDSAKFLGSLATLPIKPMPNAEDTNVTSYAVAIKSVSATGVKVPSVAPQSVGILDSGSTISLIPDSLVKPIQDKFGVIVVQIQGQAAPPMIDCAWKGSKGDGILISFEFDNKTIKVPIADMAIDSLPDELQQILKSNDAPSGFRSWTRACLFGLGGSSAFGVRDDQFYLLGDTFLRSAYVAYDMANQQIGLAQSNPNATGSNVVEIQKDAKSFPNVQGSDAPGPGEKASASGRLAPSSSVAATLLLGVAVVFSALL

SEQ ID NO: 536 - protein, 529 aa, Neurospora crassa
MKSTLATLLALASVAVAENGVVNFPLNRGVPHFRVGNVRQNVKRDTYSQALINNITGGAYYAEVTVGTPGQKVSVVLDTGSSDLWVVSYKADLCTDPSIQRQWGDSCDKTYNPTKSSSYKVLEEDSFEIRYLDNSTAAGDYITDDLNIGGATIKSLQMGYATKTVRGAGILGVGYSSNVASQQRYPNLIDQFVAQKLITTKAYSLYLNDRRSDTGSILFGGIDKDKFIGDLSILPIYLAKGQAEPIHFEVEMQSVSLALTKNGKTTKIISTDPSLSQTSTIAILDSGTTLSYLPSKITDQIHTKLSVYVDEIWTGLTFIDCQYLTSNPDLRLSFTFGANATISVPVWELVLDLLGESQSELPFKMPFKNACIFGIQSTAGFQEDNFDEDWALLGETFLRSAYVVYDLTHHQIGIAQANLNSTTTDIVELSGADGGLPTGLTGVKEQQTSNDPSGNAGSGSGSSTDKDGAKETETVTAGSTAATGTAASGAKETDSAAAGLSARGGAVGALAVASLTGFLALVGGAVVAL

SEQ ID NO: 537 - protein, 566 aa, Myceliophthora thermophila
MKPSSAILLALAPGSSSKNVVEFSVSRGLPGNRTPLSFPPLTRRETYSERLINNIAGGGYYVQVQVGTPPQNLTMLLDTGSSDAWVLSHEADLCISPALQDFYGMPCTDTYDPSKSSSKKMVEEGGFKITYLDGGTASGDYITDHFTIGGVTVQSLQMACVTKAVRGTGILGLGFSISERASTKYPNIIDEMYSQGLIKSKAFSLYLNDRRADSGTLLFGGIDTDKFIGPLGVLPLHKPPGDRDYSSFEVNFTSVSLTYTNGSRHTIPTAILNHPAPAVLDSGTTLSYLPDELADPINTALDTFYDDRLQMTLIDCSHPLLRTDPDFHLAFTFTPTTSITVPLGDLVLDILPPTYPQSNSNNNNEVEDDDDDDDDDDDDDKVPPATERRWCVFGIQSTTRFAASSGQSEANFTLLGDTFLRSAYVVYDLSHYQIGLAQANLNSSSSSTNTNTIVELTADNHDDGASERGEGAGAGADAGTRTVIAGGLPSGLMGVEAQQTTFTPTATANGHPGYGGGPGGSTRPGSERNAAAGGFTAVRTGLLGELVGVAAVTALFILLGGALIAV

SEQ ID NO: 538 - protein, 249 aa, Aspergillus nidulans
MKTAVKTTALLSLLSTAMADKAIVGGDDAEITEYPYQIALLSGGSLICGGSIISSKYVVTAGHCTDGASASSLSIRAGSTYHDKGGTVVDVEAITVHPEYNANTVDNDISILELAEELQFGDGIKAIDLPSSSSLPSEGTIGTATGWGALTEGGNVSPNLQYVEVPVVSKSQCSSDYSGFNEITASMFCAGEEEGGKDGCQGDSGGPFAADGVLIGITSWGNGCARAGYPGVYSSPAYFRDFIQQVTGL

SEQ ID NO: 539 - protein, 897 aa, Myceliophthora thermophila
MVRLDWAAVLLAATAVAKAVTPHTPSFVPGAYIVEYEEDQDSHAFVNKLGGKASLRKDLRFKLFKGASIQFKDTETADQMVAKVAEMPKVKAVYPVRRYPVPNHVVHSTGNVADEVLVKRQAAGNDTFSTHLMTQVNKFRDAGITGKGIKIAVIDTGIDYLHEALGGCFGPDCLVSYGTDLVGDDFNGSNTPKPDPDPIDNCQGHGTHVAGIIAAQTNNPFGIIGAATDVTLGAYRVFGCNGDTPNDVLIAAYNMAYEAGSDIITASIGGPSGWSEDPWAAVVTRIVENGVPCVVSAGNDGDAGIFYASTAANGKKVTAIASVDNIVTPALLSNASYTLNGTDDFFGFTAGDPGSWDDVNLPLWAVSFDTTDPANGCNPYPDSTPDLSGYIVLIRRGTCTFVEKASYAAAKGAKYVMFYNNVQQGTVTVSAAEAKGIEGVAMVTAQQGEAWVRALEAGSEVVLHMKDPLKAGKFLTTTPNTATGGFMSDYTSWGPTWEVEVKPQFGTPGGSILSTYPRALGSYAVLSGTSMACPLAAAIYALLINTRGTKDPKTLENLISSTARPNLFRLNGESLPLLAPVPQQGGGIVQAWDAAQATTLLSVSSLSFNDTDHFKPVQTFTITNTGKKAVTYSLSNVGAATAYTFADAKSIEPAPFPNELTADFASLTFVPKRLTIPAGKRQTVTVIAKPSEGVDAKRLPVYSGYIAINGSDSSALSLPYLGVVGSLHSAVVLDSNGARISLASDDTNKPLPANTSFVLPPAGFPNDTSYANSTDLPKLVVDLAMGSALLRADVVPLSGGAATATARLTRTVFGTRTIGQPYGLPARYNPRGTFEYAWDGRLDDGSYAPAGRYRFAVKALRIFGDAKRAREYDAAETVEFNIEYLPGPSAKFRRRLF

SEQ ID NO: 540 - protein, 534 aa, Myceliophthora thermophila
MRGLVAFSLAACVSAAPSFKTETINGEHAPILSSSNAEVVPNSYIIKFKKHVDESSASAHHAWIQDIHTSREKVRQDLKKRGQVPLLDDVFHGLKHTYKIGQEFLGYSGHFDDETIEQVRRHPDVEYIERDSIVHTMRVTEETCDGELEKAAPWGLARISHRDTLGFSTFNKYLYAAEGGEGVDAYVIDTGTNIEHVDFEGRAKWGKTIPAGDADVDGNGHGTHCSGTIAGKKYGVAKKANVYAVKVLRSNGSGTMADVVAGVEWAAKSHLEQVQAAKDGKRKGFKGSVANMSLGGGKTRALDDTVNAAVSVGIHFAVAAGNDNADACNYSPAAAEKAVTVGASAIDDSRAYFSNYGKCTDIFAPGLSILSTWIGSKYATNTISGTSMASPHIAGLLAYYLSLQPATDSEYSVAPITPEKMKSNLLKIATQDALTDIPDETPNLLAWNGGGCNNYTAIVEAGGYKAKKKTTTDKVDIGASVSELEKLIEHDFEVISGKVVKGVSSFADKAEKFSEKIHELVDEELKEFLEDIAA

SEQ ID NO: 541 - protein, 497 aa, Aspergillus niger
MKGILGLSLLPLLTAASPVFVDSIHNEAAPILSATNAKEVPDSYIVVFKKHVTSELASAHHSWVQDIHDSQSERTELKKRSLFGLGDEVYLGLKNTFDIAGSLIGYSGHFHEDVIEQVRRHPDVDYIERDSEVHTMEGATEKNAPWGLARISHRDSLTFGNFNKYLYASEGGEGVDAYTIDTGINVDHVDFEGRATWGKTIPTNDEDLDGNGHGTHCSGTMAGKKYGVAKKANLYAVKVLRSSGSGTMSDVVSGVEYAVQAHIKKAKDAKNGKVKGFKGSVANMSLGGGKSKTLEDAVNAGVEAGLHFAVAAGNDNADACNYSPAAAEKAITVGASTLADERAYFSNYGECTDIFAPGLNILSTWIGSNYATNIISGTSMASPHIAGLLAYFVSLQPPSDSAFAVEELTPAKLKKDIIAIATEGALTDIPSNTPNLLAWNGGGSENYTDIVGSGGYKVSSAKNRIEDRIEGLVHKAEELLTEELGAIYSEIQDAVVA

SEQ ID NO: 542 - protein, 495 aa, Aspergillus oryzae
MRGILGLSLLPLLAAASPVAVDSIHNGAAPILSASNAKEVPDSYIVVFKKHVSAETAAAHHTWVQDIHDSMTGRIDLKKRSLFGFSDDLYLGLKNTFDIAGSLAGYSGHFHEDVIEQVRRHPDVEYIEKDTEVHTMEETTEKNAPWGLARISHRDSLSFGTFNKYLYASEGGEGVDAYTIDTGINIEHVDFEDRAHWGKTIPSNDEDADGNGHGTHCSGTIAGKKYGVAKKANIYAVKVLRSSGSGTMSDVVLGVEWAVQSHLKKAKDAKDGKVKGFKGSVANMSLGGGKSRTLEAAVNAGVEAGLHFAVAAGNDNADACNYSPAAAENAITVGASTLQDERAYFSNYGKCTDIFAPGLNILSTWTGSKHAVNTISGTSMASPHIAGLLAYFVSLQPAQDSAFAVDELTPAKLKKDIISIATQGALTDIPSDTPNLLAWNGGGADNYTQIVAKGGYKAGSDNLKDRFDGLVNKAEKLLAEELGAIYSEIQGAVVA

SEQ ID NO: 543 - protein, 494 aa, Penicillium chrysogenum
MKGFLSLTLLPLLVAASPVAVNSIHNDAAPILSSMTSKDIPDSYIVVFKKHVDPSSASAHQSWLQEVHTAHTGRMELKKRSLFGFDFEAFMGLKHTFHIAGSLLGYAGHFHEDVIEQIRRHPDVDYIEKDSEVRTMSEGSVEKNAPWGLARISHRESLSFGNFNKYLYAEEGGEGVDAYVIDTGANVKHVDFEGRANWGKTIPQGDADEDGNGHGTHCSGTIAGKKFGVAKKANVYAVKVLRSNGSGTMSDVVKGVEWAAEAHIKKSKKGDKKFKGSVANMSLGGGSSRTLDLAVNAAVDAGIHFAVAAGNDNADACNYSPAAAEKAITVGASTLADERAYFSNYGKCTDIFAPGLNILSTWVGSDHATNTISGTSMASPHIAGLLAYYVSLAPAKDSAYAVADVTPKQLKAALISVATEGTLTDIPSDTPNLLAWNGGGSANYTKILADGGYKAHNAETTVEDRIGGIIDSAEKAFHKELGAIYSEIKDAVSA

SEQ ID NO: 544 - protein, 477 aa, Aspergillus nidulans
MKGIFGLSLLPLLVAASPVVVDSIHNGAAPILSSTNAKEVPDSYIVVFKKHVDPVAASVHHSWVQDIHGQKSGGRADLKKRFLGLEFGFGEEIYDGLKATFNIAGSLMGYSGHFHEDTIEEIRKHPDIEYIERNSEVHTLEDTDVEKNAPWGLARISHRDRLTFGTFNKYLYASEGGEGVDVYTIDTGINIEHEDFEGRAFWGKTIPNNDADEDGNGHGTHCSGTIAGKKYGVSKKANIYAVKVLRSSGSGTMADVVQGVEWAVESHLKKAKKGGNGFKGSVANMSLGGGKSKTLEDAVNAGVEAGVHFAVAAGNDNADACSYSPAAAEKAVTVGASTLADERAYFSNYGKCTDIFAPGLNILSTWIGSKSAVNTISGTSMASPHIAGLLAYFVSLQPSKDSAFAVDFTPEKLKKDIISIATEGVLTDIPADTPNLLAWNGGGSTNYSDIIAKGGYKSGSHVDSTPFKAGGILAQAM

SEQ ID NO: 545 - protein, 396 aa, Neurospora crassa; identical to SEQ ID NO: 179

SEQ ID NO: 546 - protein, 392 aa, Myceliophthora thermophila
MHFSTALLAFLPAALAAPTAETLDKRAPILTARAGQVVPGKYIIKLRDGASDDVLEAAIGKLRSKADHVYRGKFRGFAGKLEDDVLDAIRLLPEVEYVEEEAIFTINAYTSQSNAPWGLARLSSKTAGSTTYTYDTSAGEGTCAYVIDTGIYTSHSDFGGRATFAANFVDSSNTDGNGHGTHVAGTIGGTTYGVAKKTKLYAVKVLGSDGSGTTSGVIAGINFVADDAPKRSCPKGVVANMSLGGSYSASINNAAAALVRSGVFLAVAAGNENQNAANSSPASEASACTVGATDRNDAKASYSNYGSVVDIQAPGSNILSTWIGSTSATNTISGTSMASPHIAGLGAYLLALEGSKTPAELCNYIKSTGNAAITGVPSGTTNRIAFNGNPSA

SEQ ID NO: 547 - protein, 403 aa, Aspergillus nidulans
MHSFKRSLLLLGALLPAVFGAPVEPRRAAEKVPGKYIVTFKSGLNVDQIDAHTSWASNVHKRNLERRGLAERDQYSGIEKNYKINKFAAYSGSFDDATIEEIRNSADVAHVEEDQIWYIDALTSQSGAPWGLGAISHKGEASTTYVYDTSAGEGTYAYVVDTGINADHEEFGGRASLAYNAVGGQHVDSVGHGTHVAGTIGGETYGVSKKANLLSVKVFQGESSSTSIILDGFNWAANDIVSKGRTGKSAINMSLGGGYSYAFNQAVEDAYDEGVLSVVAAGNDNIDASDSSPASAPNALTVAASTKSNTRASFSNYGSVVDIFAPGQDILSAWIGSTTATNTISGTSMATPHVVGLSLYLIALEGLSSASAVVSRIKELATQGVLSNVQGSPNLLAYNGADE

SEQ ID NO: 548 - protein, 420 aa, Myceliophthora thermophila
MAGRLLLCLTAALSALGVSAAPAPDASGRPFIGVPVSNPGIANAIPNRYIVVYNNTFNDEDIDLHQSNVIKTIAKRNIAKRSLTGKLLSTTVNTYKINNWRAMALEADDATINEIFAAKEVSYIEQDAVISLNVRQMQSQATTGLARISHAQPGARTYIFDSSAGEGITAYVVDTGIRVTHEEFEGRATFAANFIDDVDTDEQGHGSHVAGTIGGKTFGVAKKVNLVAVKVLGADGSGSNSGVIAGMQFVASNATAMGLKGRAVMNMSLGGPASRAVNSAINQVEAAGVVPVVAAGNESQDTANTSPGSAEAAITVGAIDQTNDRMASFSNFGELVDIFAPGVNVQSVGIRSDTSTNTLSGTSMASPHVAGLAAYIMSLENITGVQAVSDRLKELAQATGARARGVPRGTTTLIANNGFA

SEQ ID NO: 549 - protein, 398 aa, Penicillium chrysogenum
MGFLKVLATSLATLAVVNAGKLLTGSDAGAVVPGSYIVVMNDGVSNDVFKNHRDWAATVHARIASRKGGESGPGKNFDINGMKGYTASFDDRTVKDIASDPAVKYVEPDMVVNATENVVQPNAPSWGLPRISSQKPGATDYVYDSTAGEGIVVYGVDTGIDIRHSDFEGRAEWGTNTVDNDNTDGNGHGTHTASTAVGSKFGVAKKASVVAVKVLSADGSGTNSQVIAGMEWAVKDAKSRGVTGKSVMNMSLGGAFSRAMNDAAANVVKSGVFLSVAAGNEAQDASNSSPASAPNVCTIAASTSSDRSASFSNFGSVVDLYAPGESITAAYPGGGSKTLSGTSMAAPHVAGAAAYLMALEGVASDKACARIVELAISSISSAPFGTTSKLLFNGLNAK

SEQ ID NO: 550 - protein, 421 aa, Neurospora crassa
MVGLKNVALFAASIILPASITWAAPIIEVETKPIPEKYIVLLKPHADLEGHLSWAKDVHARSLSRRDTAGVHKAWSVGSKFKAYAGEFDEETLKIIQRDERNVHSIEPDKSWRLYKSNKKDNDDSNSDNTTIITQKQAPWGLGYLSHKGKTSSDYVYNSTAGTGTYAYVVDTGCWKDHVEFEGRVQLGYNAYPDSPFIDMDGHGTHVTGTLISKTYGVAKNATVICVKVFHGGGSANTIVMDGFEWAVKDIIAKKRQRNSVINMSLGCDRSEAFNAIVDAAYDQGILTVVAAGNENQPAALVSPASSARAFSVGAIDNKNTRAYFSNYGAIVDIFAPGVNIVSTYIGKKDGDNNRTMTMSGTSMASPHVAGLALYLKSLDPEKYGNSSDAHSGLRALGVPDKVWDAGEMSPNLVAYNGVQG

SEQ ID NO: 551 - protein, 658 aa, Aspergillus nidulans
MAATGRFTAFWNVASVPALIGILPLAGSHLRAVLCPVCIWRHSKAVCAPDTLQAMRAFTRVTAISLAGFSCFAAAAAAAFESLRAVPDGWIYESTPDPNQPLRLRIALKQHNVAGFEQALLDMSTPGHSSYGQHFGSYHEMKQLLLPTEEASSSVRDWLSAAGVEFEQDADWINFRTTVDQANALLDADFLWYTTTGSTGNPTRILRTLSYSVPSELAGYVNMIQPTTRFGGTHANRATVRAKPIFLETNRQLINAISSGSLEHCEKAITPSCLADLYNTEGYKASNRSGSKVAFASFLEEYARYDDLAEFEETYAPYAIGQNFSVISINGGLNDQDSTADSGEANLDLQYIIGVSSPLPVTEFTTGGRGKLIPDLSSPDPNDNTNEPFLDFLEAVLKLDQKDLPQVISTSYGEDEQTIPEPYARSVCNLYAQLGSRGVSVLFSSGDSGVGAACQTNDGKNTTHFPPQFPASCPWVTAVGGTNGTAPESGVYFSSGGFSDYWARPAYQNAAVESYLRKLGSTQAQYFNRSGRAFPDVAAQAQNFAVVDKGRVGLFDGTSCSSPVFAGIVALLNDVRLKAGLPVLGFLNPWLYQDGLNGLNDIVDGGSTGCDGNNRFNGSPNGSPVIPYAGWNATEGWDPVTGLGTPDFAKLKALVLDA

SEQ ID NO: 552 - protein, 601 aa, Penicillium chrysogenum
MIASLFNRGALSLAVLSLLASSASADVFESLSAVPQGWRYSRRPRADQPLKLQIALAQGDTAGFEEAVMDMSTPDHPSYGNHFHTHEEMKRMLQPSAESADSIRDWLESAGINRIEQDADWMTFYTTVETANELLAANFQFYANSAKHIERLRTLQYSVPEALMPHINMIQPTTRFGQLRVQGAILHTQVKETDEAFRSNAVSTSPDCNSIITPQCLKNMYNVGDYQADDDNGNKVGFASYLEEYARYSDLELFEKNVAPFAKGQNFSVIQYNGGLNDQHSSASSSEANLDLQYIVGVSSPVPVTEFSVGGRGELVPDLDQPDPNDNNNEPYLEFLQNVLKMEQQDLPQVISTSYGENEQSVPEKYARTVCNLFSQLGSRGVSVIFASGDSGVGAACQTNDGRNATRFPAQFPAACPWVTSVGATTHTAPEKAVYFSSGGFSDLWDRPKWQEDAVSDYLDTLGDRWSGLFNPKGRAFPDVSAQGQNYAIYDKGSLTSVDGTSCSAPAFAGVIALLNDARLKANKPPMGFLNPWLYSTGRDGLNDIVHGGSTGCDGNARFGGPGNGSPRVPGASWNATKGWDPVSGLGSPNFATMRKLANGE

SEQ ID NO: 553 - protein, 588 aa, Aspergillus niger
MIYVNYILGLLSLLHTAVATAPDYVVVDQLNSIPDGWTKGAAPPPFTPMKFWLSMHHEYKADFEQKVIDISTPGHRDYGRHMKRNDVMAFMRPSDQVSKIIFSWLESEHVPPNAIEDRGDWVAFTVPLAQAQSMMKTDFYNFHHLETNTTQIRTLKYSVPEQVDAHLQMIQPTTRFGRPKTQTSLPSLMPVSVNIDEISEDCLTGVTPICLRQLYGLPSTKASPDSRNVLGISGYLDQYARYSDLDEFLAVYSPNSVDADFSVVSINGGQNPQNSQEGSTEASLDIQYALSMAFDANATFYTTAGRAPSVSDSGTVSTDGSTNEPYLEQLQYLVGLPDEDLPAVLSTSYGEDEQSLPEEYTEATCNLFAQLGARGVSVIFSSGDSGVGGSCVSNDGSQRTRFQPIFPASCPFVTSVGGTEGVGPEKAVDFSSGGFSERFARPSYQNASVEAYLARLGDKWDGLYNPDGRGIPDVSAQASNYVIRDHGQWLQTAGTSAAAPVFAAVISRLNAARLEQGKPTLGFLNPWLYSLDQQGFTDIVDGGSVGCDGSNGGALVPYASWNATKGWDPVTGLGTPLYQTLEQLAQSA

SEQ ID NO: 554 - protein, 600 aa, Aspergillus oryzae
MFFSRGALSLAVLSLLSSSAAGEAFEKLSAVPKGWHYSSTPKGNTEVCLKIALAQKDAAGFEKTVLEMSDPDHPSYGQHFTTHDEMKRMLLPRDDTVDAVRQWLENGGVTDFTQDADWINFCTTVDTANKLLNAQFKWYVSDVKHIRRLRTLQYDVPESVTPHINTIQPTTRFGKISPKKAVTHSKPSQLDVTALAAAVVAKNISHCDSIITPTCLKELYNIGDYQADANSGSKIAFASYLEEYARYADLENFENYLAPWAKGQNFSVTTFNGGLNDQNSSSDSGEANLDLQYILGVSAPLPVTEFSTGGRGPLVPDLTQPDPNSNSNEPYLEFFQNVLKLDQKDLPQVISTSYGENEQEIPEKYARTVCNLIAQLGSRGVSVLFSSGDSGVGEGCMTNDGTNRTHFPPQFPAACPWVTSVGATFKTTPERGTYFSSGGFSDYWPRPEWQDEAVSSYLETIGDTFKGLYNSSGRAFPDVAAQGMNFAVYDKGTLGEFDGTSASAPAFSAVIALLNDARLRAGKPTLGFLNPWLYKTGRQGLQDITLGASIGCTGRARFGGAPDGGPVVPYASWNATQGWDPVTGLGTPDFAELKKLALGN

SEQ ID NO: 555 - protein, 587 aa, Neurospora crassa
MLWSVLLLAAGASAHVKSSLPSVPSGWKKVRAASADESVSLKIALPAHQPDALETAILRVSDPNHHEYGMHLSSEEVRSLVAPADETTDAVTSWLNRNGIKGKVDNDWVSFTTSVAKANNLLNTTFDWYQQDGDKTGPKLRTLQYSVPDELDAHVDMIQPTTRFGKLAAKASTIFEIFDEPEPKNIANVKVGGDHPTCTGCIYPDEIRSLYNIKYKPSASDKNTIAFASYLEQYSNYDDFTSFAKAFIPDAADRNYTVKLVKGGLHDQSPDKIGVEANLDLQYILAISNPIPIREYSIGGRGPLVPTANQPGPEISNEPYLDFFQYLLSLKNSELPATLSTSYGEEEQSVPREYALKVCSMIGQLGARGVSVIFSSGDSGPGDACIRNDGTNSTYFEPTFPGACPWVTSVGGTYQTGPEKAVDFSSGGFSMYHKRPVYQERVVKKYLDKIGDTYSDFFDEQGRGFPDVSAQASRYAVYVDGRLVGVSGTSASAPMFAGLVALLNAARKSHGLPSLGFINPLLYASKDAFTDIVNGAGTGCRGRPEFAGDVGGTAKWNATEGWDPVTGLGTPKFDKLLALAAPGVKNA

SEQ ID NO: 556 - protein, 644 aa, Aspergillus fumigatus
MRLSHVLLGTAAAAGVLASPTPNDYVVHERRAVLPRSWTEEKRLDKASILPMRIGLTQSNLDRGHDLLMEISDPRSSRYGQHLSVEEVHSLFAPSQETVDRVRAWLESEGIAGDRISQSSNEQFLQFDASAAEVERLLGTEYYLYTHQGSGKSHIACREYHVPHSLQRHIDYITPGIKLLEVEGVKKARSIEKRSFRSPLPPILERLTLPLSELLGNTLLCDVAITPLCISALYNITRGSKATKGNELGIFEDLGDVYSQEDLNLFFSTFAQQIPQGTHPILKAVDGAQAPTSVTNAGPESDLDFQISYPIIWPQNSILFQTDDPNYTANYNFSGFLNTFLDAIDGSYCSEISPLDPPYPNPADGGYKGQLQCGVYQPPKVLSISYGGAEADLPIAYQRRQCAEWMKLGLQGVSVVVASGDSGVEGRNGDPTPTECLGTEGKVFAPDFPATCPYLTTVGGTYLPLGADPRKDEEVAVTSFPSGGGFSNIYERADYQQQAVEDYFSRADPGYPFYESVDNSSFAENGGIYNRIGRAYPDVAAIADNVVIFNKGMPTLIGGTSAAAPVFAAILTRINEERLAVGKSTVGFVNPVLYAHPEVFNDITQGSNPGCGMQGFSAATGWDPVTGLGTPNYPALLDLFMSLP

SEQ ID NO: 557 - protein, 645 aa, Aspergillus oryzae
MKTSFLLLHTLVAGVLAIPTRTDYVLHERRDAVPAHWTGEKRLDGQTVLPMRIGLTQSNLDRGHDLLMEVSTPGSPRYGDHMTLDEVHNLFAPSQDSVDSVRSWLESAGISPDRISQSTNKQWLQFDAGVDEVEQLLKTEYYRYSHAGTGRSHVACREYHVPESVQSHIDYITPGIKHLEIREEKPVEKRSLDKRSFGILPPILRPLTLPLEELLGQLLLLCDVAVTPACIQAMYNVTDGDKATKGNELGIFEDLGDVYSQDDLDLFFSTVAHKIPTGTHPILNAIDGAQAPADTTNAGTESDLDFEISYPLIWPQNSILFQTDDPIYQNNYTYNGFLNNFLDAIDGSYCSEASPLDPPYPNPADGGYKSPRQCGVYKPTNVISISYGGAEADLPIAYQRRQCQEFMKLGLQGVSIVVASGDSGVQGRGGSPTPSGCLGKDNKVFAPDFPATCPYLTTAGGTYLPPGADVHAHEEQATTSFPSGGGFSNIYQRPDYQNAAVEEYFNTAQLSYPYYESVDNSSFAANGGIYNRIGRAYPDVAAIADNVLVFNKGLPTLVGGTSAAAPVFAALLTRINEERLAAGKKTVGFVNPVLYANPGVFFDVTKGSNQGCGTDGFPAVKGWDPVTGLGTPNYPKLLELFMGLD

SEQ ID NO: 558 - protein, 642 aa, Penicillium chrysogenum
MLCVLAASAMAVPTAHDYQLHERRDFIPKSWVEGKELDGNVSLPVRIGLTQSNLDYGHELLMDLSNPHSSRYGQYLSVNEVHDLFAPTEKSVNDVRYWLESAGIAKERITQSANKQWIQFDADAEELEHLLHTKYYLYSHAETGRSHVACREYGFHLDWIYSLADHRPQISCPELRISLREVTSVRRSTKQKRFMDGVPPILEPILLPIEELLSQSPSLCSQAITPQCIQQMYNISEGHSATEGNELGIFEGIGDVYAQEDLDLFFSKLYSKIPQGTHPILKSVDGGEAPTDTSRAGPESDLDFQISYPIIWPQNSILFQSDDMHYENHYTFRGFLNTFLDAIDGSYCSTISPLDPPYPDPADGGYKGSLQCGVYDPPKVISISYGSAEADLPISYQRRQCAEFMKLGTMGVSVLVASGDSGVSGRGGDPTPSNCLGTNGRVFAPDFPATCPYLTAVGGTEIPTGSSPEDHQEQAVTRFPSGGGFSNIYKAPEYQAQAVADYFDKAQPSYPYYESVDNSSFGENSGIYNRIGRAYPDVAAVGDKVVIYNRGMAVSIGGTSASAPVFAAILTRINEERLAAGKSTVGFVNPVLYAHPEAFFDVVTGSNPGCNTDGFSAAKGWDPVTGLGTPNYPELLRVFMGE

SEQ ID NO: 559 - protein, 611 aa, Aspergillus nidulans
MWLSLLYLVSSITAVLAFSPPAKHPLHERRDALPDYWVEDARLDGQTVLPVRIGMTQSNLDHGHDLLMLISDPSSPEYGKYLSAKEVHDLFAPAEETVERVRAWLESEGISDTRISQSANKQWLRFDATAQELERLLQTEYYLYSHAETRRSHIACREYHVPEALQKHIDYITPGVKFLEIAGPLPILPTERSLTRRDTADASSPIIDGTNLTLSQVTNDALGFCDQIITPACIRGMPCICQPIVHSINGGTAPTTLDNAGPESTLDLAMSYPIIWPQNPIIFQTDDPIWADINNPKFPGIFNNFLDAIDGSYCDPSEEELDPPYPNPAPGGYKGQKQCGVYKPTNVISISYGFAEFELPIRYNRRQCYEWMKLGLQGVSVVAASGNNGVATGGCLGKDRSVFTPGYLICPYITTVGGTYLLPGGDPYNPLEVAVDPSTTPGNWSSGGGFSNIYERPMYQASAVEEYFSRANLNYPYYESINNDSFAANDGIYNRIGRAYPDISAVAVNNFVFWRGGPILGGGTSASAPIFAAILTRINEERLAAGMPTVGFVNPMLYAHPEAFRDITEGNNPGCSTDGFTALEGWDPVTGLGTPIYPKLLEVFMSVKLGL

SEQ ID NO: 560 - protein, 659 aa, Penicillium chrysogenum
MAGYHYSFIVSRDAAPVKHVLHEKRSEHVDWVKGERIKRDSVLPVRIGLAQNNLERGDEYLMAVSDPDSAKYGQYWSAEEVHEFFAPSKDSVDSVRRWLQSSGIHESRIVHSDNKGWLAFDAYAHEVEDLFKAEFYEHEHASTSSMKIGCEEYHVPENIQAHIDYITPGVKLSPIVKKNTKAKRMSHLAHSKGTVEADNSIKTTVISEKAQSLPADLQRCGTDMTPACIMALYDIPDATKAAKGNSLGLYEQGDYFAKSDLDLYYKHFAPWIPRGTYPIPALIDGASFSVPDYSPLNAGEADIDIDMAYSLIYPQSITLYQVDDQTYEPEEEKTTNLFNTFLDALDGSYCTYSAFGETGNNPDIDPVYPNPRPGGYKGELQCGVYKPTTVISASYGQAEADLPIAYTKRQCNEFMKLGLQGHSILFSSGDYGVASFHNDGAVNGCLGPEGKIFNPQYPSNCPYVTSVGGTMLYADQTVKDAESVMSANLGGDSANFTSSGGFSNYFPQPSYQKKAVEKYFQKAKLTYPYYSEMEVNINKTKGLYNRIGRGYPDVSANGAVFPAYNGGKLTHYYGASLASPLFASVLNLINEERLDQGKGPVGFVNPVLYAHPEVLNDITNGTNLGCGSDGFSAIPGWDPATGLGTPNYPKLKELFLSLP

SEQ ID NO: 561 - protein, 720 aa, Myceliophthora thermophila
MRIRHALVGIASLCCLLGTASGARISSRDMLSRRVVPPSHTLHERHEAGNVEGWVKRGLADAESTVPVRIGLKQSNVDAAHDLLMDISDPRSPNYGKHLSRSEVEDLFAPREHSVAKVKRWLASAGVDEGRISQSANKQWIQFDAPVYELEKLLLTRYHIFENLETGVQNIACSEYHVPRDVSHHIDYITPGIKLMAGGREERMVRWRKADRRSLVAGLASQGRKGAHGMGHGGGGGSRSPDDPVVDDSPFRVTGPCSAEITPNCIRAQYQLPNGTRAASGNELGIFQGLGQHYSQEDLDNYWKYVAPWVPRGTHPELRSINGALGPANDTLRAGEEADLDFQIAIPLIWPQRTVLFQTDDEWYQQDQQRADTKYPGFFNTFFDAIDGSYCHMTAFNMTGNCVTPECRDPEYPNPNATPEQGGYAGALMCGRHRPTSVVSVSYSGTEDSWPASYMRRQCLEVLKLALQGVTVVESSGDFGVGGRPFDPRAGCLGPDRAVFSPRVMANCPYVLSVGATALVDPEQEQQQQHADRGGSGKEPRLVEVAARTFASGGGFSNIFGRPKWQDRHVREYLRKTNLSELGYDNAAGMSFDSLRPPPAGGKLFNRLGRGYPDVAAVGQNFRVVLRGYPNRMHGTSAAAPVWASILTLINEERRAVGKGPVGFVHQVLYQHPEVFTDITVGSNPGCGTDGFPVEEGWDPVTGLGSPIYPKLLKLFMSLP

SEQ ID NO: 562 - protein, 719 aa, Neurospora crassa
MFRFHLWTLLRLFALLSSLVTASRIVLEEAGHLPAGWKVERHATASDRIQLSIALKEPGIEELKRRLLQQSTSDDHPNSRQFTKEEVEKHRQPDQRSVTAVGRWLQSHGIKSYNADNSWITFKATAATVQMLFEADLAYYSYNGDPSTQILRSRSYTIPRWLSDDIDFVHPLTNFMPPRNRNDGTLGIGRRQPIQPKLSAREDFFAPPCWTGTFPGCIRKLYNLTYTPSPDFRSPSPVRFGIASFLEQYITHRDVTSFLATYARELLPLRPTPSRGGSGGSLTLPPVTNTTSEPPYNITITLLNNATRWDPHSTDPALSGLEANLDVQYALSLGHPTRVIYYATGGRGTKLDSSGRPLPTNDPRANNEPFLEFLQALLALPDNQIPHVLSISYADDEQSVPRKYAHRVCDLFAAVAARGTSVLVATGDGGAAGIGFSAGGGDTCIKNDGSGRRAFVPTFPASCPWVTSVGATDNTALNLTGAAFSSGGFSEYFDRPLWQRAAVDPYVSSLLRSRSSKPGQPSQPRDLKGVYFSHNGRGMPDMAAIGSGFQIIHRGEMVEVRGTSASTPVVAAMVALVNDQRLRQGKRSLGWLNGHLYLDPRVRRVLTDVKWGRSEGCVFPGEALEEGRGKGKEKYWRHSVVEKRQGNSEEDGGTHGGDGEGKADEEDWGGEGEVGEGEGDQSENVILGGWDARKGWDPVTGLGVPGDFQEMLKVLGSVW

SEQ ID NO: 563 - protein, 639 aa, Aspergillus niger
MHVSLFLLSVTAAFASPTPHNYVVHERRDALPSVWVEESRLDKGALLPMRIGLTQSNLDRGHDLLMEVSHPQSSRYGKHLSSEEVHDLFAPSNEAVETVRTWIESAGIAPSRISQSYNKQWLQFDAHASEVEQLLQTEYYIYTHADTGSSHVTCHEYHVPETIQSHIDYITPGVKMLEVRGTPSKKRDAEKRSLGSLPPILAPLPINITKIFDDPLAHCDLAVTPDCIRAMYNITKGTTATKGNELGIFEDLGDIYSQDDLNLFFANFASDIPQGTHPTLDSIDGATAPTDVTNAGPESDLDFQIAYPIIWPQNTILYQTDDPNYEDNYNFKGLLNNFLYAIDGSYCNETSSLDPQYPDPSPGGYSSPKQCGVYTPTNVISISYGSPEADLPIAYQRRQCHEFMKLGLQGISVVVASGDSGVASSTGTCFGDADNVFVPDFPATCPYLTAVGGTYLPLGADAAKDQEIAVTRFPSGGGFSNIYARPSYQNHSVETYFSTTSDDLTYPYYSGVNYTDFSNTDGVYNRIGRGYPDVSAIADNIIIYNQGEATLVGGTSAAAPAFAAMLTRINEERLAKGKSTVGFVNPVLYEHPEAFRDVTVGSNPGCGTDGFPVAGGWDPVTGLGTPRFEDLMDIFVGDD

SEQ ID NO: 564 - protein, 602 aa, Aspergillus fumigatus; identical to SEQ ID NO: 155

SEQ ID NO: 565 - protein, 611 aa, Aspergillus niger
MLSSLLSQGAAVSLAVLSLLPSPVAAEIFEKLSGVPNGWRYANNPQGNEVIRLQIALQQHDVAGFEQAVMDMSTPGHADYGKHFRTHDEMKRMLLPSETAVDSVRDWLESAGVHNIQVDADWVKFHTTVNKANALLDADFKWYVSDAKHIRRLRTLQYSIPDALVSHINMIQPTTRFGQIQPNRATMRSKPKHADETFLTAATLAQNTSHCDSIITPHCLKQLYNIGDYQADPKSGSKIGFASYLEEYARYADLERFEQHLAPNAIGQNFSVVQFNGGLNDQLSSSDSGEANLDLQYILGVSAPVPITEYSTGGRGELVPDLSSPDPNDNSNEPYLDFLQGILKLNNSDLPQVISTSYGEDEQTIPVPYARTVCNLYAQLGSRGVSVIFSSGDSGVGAACLTNDGTNRTHFPPQFPASCPWVTSVGATSKTSPEQAVSFSSGGFSDLWPRPSYQHAAVQTYLTKHLGNKFSGLFNASGRAFPDVSAQGVNYAVYDKGMLGQFDGTSCSAPTFSGVIALLNDARLRAGLPVMGFLNPFLYGVGSEKGALNDIVNGGSVGCDGRNRFGGTPNGSPVVPFASWNATTGWDPVSGLGTPDFAKLKGVALGEEGGN

SEQ ID NO: 566 - protein, 596 aa, Aspergillus fumigatus
MAPFTFLVGILSLCICCIVLGAAAEPSYAVVEQLRNVPDGWIKHDAAPASELIRFRLAMNQERAAEFERRVIDMSTPGHSSYGQHMKRDDVREFLRPPEEVSDKVLSWLRSENVPAGSIESHGNWVTFTVPVSQAERMLRTRFYAFQHVETSTTQVRTLAYSVPHDVHRYIQMIQPTTRFGQPARHERQPLFHGTVATKEELAANCSTTITPNCLRELYGIYDTRAEPDPRNRLGVSGFLDQYARYDDFENFMRLYATSRTDVNFTVVSINDGLNLQDSSLSSTEASLDVQYAYSLAYKALGTYYTTGGRGPVVPEEGQDTNVSTNEPYLDQLHYLLDLPDEELPAVLSTSYGEDEQSVPESYSNATCNLFAQLGARGVSIIFSSGDSGVGSTCITNDGTKTTRFLPVFPASCPFVTAVGGTHDIQPEKAISFSSGGFSDHFPRPSYQDSSVQGYLEQLGSRWNGLYNPSGRGFPDVAAQATNFVVIDHGQTLRVGGTSASAPVFAAIVSRLNAARLEDGLLKLGFLNPWLYSLNQTGFTDIIDGGSSGCYVGTSNEQLVPNASWNATPGWDPVTGLGTPIYNTLVKLATSVSSTP

SEQ ID NO: 567 - protein, 595 aa, Aspergillus flavus
MPSQQMVLFAYTIGAFSLVLHLLVAALATGPRYSVVERLEKIPDGWVDVGTPSPSKPIELQLAVHPEKITEFEQRVIEISTPGNQNYGRHMSRDEVRNFLYSSDVAPRKVLSWLKAAHIPATSINKHTGWITFTVPVSQAEQLLRTRFYTFEHKKSRATVVRTLKYSVPKELRSFVQMIQPTTRFGQLMPQTEPPLLQALPVTLKDLVAGCSSIVTPSCLRKLYGISDSKPKPDRRNRLGVSGFLDQYARYSDFHQFLRLYAPNITDNNYTVELINGGLNLQDSLEDSSEASLDIQYAAALADTPFTTFYSTAGRGPVIRDLGHNDPSDPHEPYLEQLRYLLDLPDDELPAVLTTSYGELEQSVPEIYARTTCNMFAQLGARGVSVIFSSGDSGVGDSCITNDGTNRTRFQPLYPASCPFVTSVGGTYGKEPEMAIGYSTGGFSEYFPRPSYQDGSVNQYLSQLGSKWEGLYNPNGRAIPDVAAQADHFIIMDHGQLLKTGGTSAAAPVFAGIVSRLNAARLESNKPRLGFLNPWLYSLNQTGFTDIVDGGSVGCFGDVGREVPYASWNATPGWDPVTGLGTPYYKALVEQAMSI

SEQ ID NO: 568 - protein, 1068 aa, Aspergillus nidulans
MVSLSFLAGTLSLVIACFVNVVAADFGYVTVERLQRAPDGWIRGPVAPPFKMIKFHIALRQEKAAELEQVTLDMSTPGHHNYGRHLKRDDVRAFVRPSGETMNRVLAWLESAEIPAESVRTHGNWMEVILPVSRAESLMKTKFHIYTHRDTHRRAIRTLSYSVPRALFPDIQLIQPTTHFGQAVAQGKRPNFQPVAATFDRLTADCSTTITPDCLRELYGLYDTNAKPDVRNRLGISGYLEEYARYSDFHQFMHQFSPNRTEANFSVVSINGGLNLQNSSLPSSEASLDVQYAISLAYNTFATYYTTAGRAPFLPGATGTDEDISINEPYLEQLHYLLDLPDEELPAVLTTSYGEDEQSVPESYAEATCNLFAQLGARGVSVIFSSGDGGVGGSCLANDGTNRTRFQPIFPASCPFVTSVGGTEGMNPERAVEFSGGGFSDRFARPSYQDSSVLGFLKTLGGKWDGLYNPQGRGIPDVAAQANNYIIIDHGKTYHIGGTSASAPVFAAIVSRLNAARLEDGKPRLGFLNPWLYSLNQTGFTDIVDGRSPRPACVSMKTRPGSSAWAKAISADPKTKRGLTHRAPMMYGCHPPWPLCSRPRIVRSTYPCHTAYILHTRVPQFGWEKTIQSSLNGRPPKVPRPGPTSKWATAESPPECQKFPAAEFAEDGIQVTLKTGGAESRDLLHSHVEGVTSCIPNLLVVSDMGQQLGPFYTHDVLADVIHVLSEEDRLVYQRQREDHFYWNKKLQPTKAGWRLDRYKFLAMIEYAYARNPSAKWYVFMEADTTVIWQNLVQLLSRYKWIDPIYIGSPTPGRPIGTWWDPEPTFFVYGGSGIVLSVTAIEHLLREDLEGSAKAESGQTSQLLITKYQDMVREDCCGDSVLGWVAAQRDVKIKGLWPMFNPHPLHGTPLGKSYWCQPVITFHKSDPVQVVELWKWQTERQKKGNDPRPILYSDIVDFFDFEATPVRENWNNADMDSFDASTHEAHDSFDSCKEACHKHDHCFQFTYHRKKCRMARVIRLGNSVSMDGDGDAKAGRSLAGWDVKKIKEFKKAHNCEKVDWPEPSTERIF

SEQ ID NO: 569 - protein, 593 aa, Penicillium chrysogenum
MRLQFLLLRALGLFLCYTQLVFAVDASYELVEQLDKAPDGWSRGDKPPASKFIKFRLAIAQHNAREFEQKVIELSTPEHPSYGQHMSRDEVKQFLTPHPAISDRIIAWLRSENVPANSINLYGHWVSFIVPIFQAERMLKTQFFYFHQQGQENPAIRTLGYSVPRALRSHIQLIQPTTLFGNLVPQKSPVFKQKIATPEKLAAGCDVTITPDCLRDLYKIDNTTTRPDWRNRLGISGFLEQYARHDDFNEFLRRYAQSHTDANFSVVSINGGQDGQHSMSDSVEANLDVQYSIPLADEVLATFYSTGGRGPVVPEITHPDPTESSNEPYLEQLHYLLDLPDEELPAVLSNSYGENEQSLPPSYLNATCSLFAQLGARGVSILFGSGDSGPGSSCVKNDGTNQTRFLPGYPASCPFVTAVGGTYGTNPEKAVPFSGGGFSEVFSRPQYQDQAVKGYLGHLGNQWNGLYNATGRGYPDISAQAANFIVRDQGDWISVGGTSASTPVLAGVISRLNAARIAQGKPRMGFLNPWLYSHGQTGFTDIVLGSSSGCKWTSDARVRNASWDATEGWDPATGLGTPLFPALVKLVLSDGQA

SEQ ID NO: 570 - protein, 568 aa, Aspergillus fumigatus
MLSSTLYAGWLLSLAAPALCVVQEKLSAVPSGWTLIEDASESDTITLSIALARQNLDQLESKLTTLATPGNPEYGKWLDQSDIESLFPTASDDAVLQWLKAAGITQVSRQGSLVNFATTVGTANKLFDTKFSYYRNGASQKLRTTQYSIPDHLTESIDLIAPTVFFGKEQNSALSSHAVKLPALPRRAATNSSCANLITPDCLVEMYNLGDYKPDASSGSRVGFGSFLNESANYADLAAYEQLFNIPPQNFSVELINRGVNDQNWATASLGEANLDVELIVAVSHPLPVVEFITGALPPVLRVLALQTQLPSSSGDFQLTVPEYYARRVCNLIGLMGLRGITVLESSGDTGIGSACMSNDGTNKPQFTPTFPGTCPFITAVGGTQSYAPEVAWDGSSGGFSNYFSRPWYQSFAVDNYLNNHITKDTKKYYSQYTNFKGRGFPDVSAHSLTPYYEVVLTGKHYKSGGTSAASPVFAGIVGLLNDARLRAGKSTLGFLNPLLYSILAEGFTDITAGSSIGCNGINPQTGKPVPGGGIIPYAHWNATAGWDPVTGLGVPDFMKLKELVLSL

SEQ ID NO: 571 - protein, 580 aa, Aspergillus fumigatus
MYPLDGSARPHPPGTTRLNSVEPDKQIGFTVLVRPQTGAPRLPDLAQWQAIPIAERQFLSTAGFERTYGSSEDDIVSVASFLEKAGMTIRSRHAGAGTVEVQAKTCQIHSVFAVQLLYYRGQLRPAARKRRDDKQPAEETYIGFEGCISLPAALHDKVIHIFGLDTRTFGASGGYSGDPPRAQRLIVAELAALYGFPAGVDASQQTIGIFSGEGNDDKGQSLSNYRPADVAAYFNNQTVGYNRAPTVVPVSLTVADQTYRNDPDHPTQELSQDIMTAATIAQGCTVNVYFSDLTEQGWLAFLTRVLFPQGEEKRPTIVSISWTMYDEQTYRDRLSFLFQRLAVVGTSVFAIAGDWGANNNIIDGQPHVGWPGSDPWVTCVGGTVVGNVRSSGAFTEHAWSDRDNPDSQFTIDGHLGVTGGGMSRVFATPPYQLSSGISAVTDCNGERWTGGRFIPDITGMVGFRGFIVNGKRNYFIGTSCSTPLYAGLFAALASALGGGGEGGVLFGPLNTVLYQIDRGVYRDITFGHNDSGDMPACAYFAAGEGYDTVSGLGSVDGRRTLEELRRIYWPKTKGFGCFRN

SEQ ID NO: 572 - protein, 454 aa, Neurospora crassa
MRATLVVVLCHLSLAFALAISPAASHWKRSARLASDQTASERYSLPSRVARYIDYVLPAPDPDPVSSAPKSVAVQDPPTLKGVIGARQTRDVDCLQYIAPQCLRQLAWLAEDLDMFFGDFAPDLLTNFNLEPNLDYKYTMAMAKPIPVTNIQVGDFVVQGNMNIMLAAFNAHYCRTGLDPQFDPVYPNPAPGGYNASDCGTHVPPRVIAIMYAWNKAWYSDADFASIFPASDPWVTSVGGTQFLPVVSNGSSSTTASSGMPSSSSSSSSSSSSSSSSSSSSLFPGETALDDNNTGSSGGSFSRLFPGPWYQGNLTREYLASAPGAAELARQGYFNGSGRGYPDISAMARSFLVALHGGYHAVSGTSASTPVVAAMVAKINDARLHAGKSTVGFLNPVLYSAAAGKAGVLRDVPLGKNHDCGVGEAFPARRAWDAVTGLGTPDFEKLKELYLGLP

SEQ ID NO: 573 - protein, 652 aa, Aspergillus oryzae
MRPLSHLSFFNGLLLGLSALSAATSVVHERREATSSNWVKRARVNPSDKHVVRIGLTQSSLEEAHDLLMDVSNPSSPNYARFYSADEVAAKFAPSTETVNEVQNWLTEKGINASRVARTQNHGWLVFHATSKEIENLFDTTYYEYHNRKTGKKAIACEQYHVPASVQKHIDYVHPGVNLNPSSGKPSSIRRRAAASKKTKLPARGPRPIQQHDVKGLNVTNCDQLITPECIRALYKIPSARAAPHPNNSLGIFEEGDYYAQEDLDLFFKTFAKDIPQGTHPIPAFIDGAEAPVPVTKAGGESDLDFELAYPIVHPQSITLYQTDDANWASNTTGFLNTFLDALDGSYCTYCAYGECGNDPSLDPVYPDDAGYDGQLMCGVFKPTNVISVSYGEQENDLPANYQQRQCMEFLKLGLQGVSVLFASGDNGVAGPPGDGNSVNGCLNNGTVFSPAFPNSCPYITNVGATKVYPGYTVSQPESAVYDPDGLYSYASGGGFSNIYPIPDYQAEAVATYFKDHNPPYPYYEGAENLGKNGGLYNRLGRGYPDVAANGDNIAVFNGGEFGSSGGTSASTPIFASIINRIIDERLAVGKGPVGFINPVLYKNPSVLNDITNGTNPGCGTDGFSTAPGWDPATGLGTPNYPKMLKLWLDLP

SEQ ID NO: 574 - protein, 243 aa, Myceliophthora thermophila
MKLAVLIATTAGLAAALPQGVARRGVGRPLHHSGPNIRNTTYPQYSSNWAGAVQIGTGFTSVYGTITVPSVHDRNPNAAASAWVGIDGDTCQQAILQTGVSFYGDGSFDAWYEWIPDYAYSFSNFRLSAGDQIRMSVEASSKRAGVATLENLSTGQKVSHTFTSTPSTLCETNAEWIVEDFQEGSSLVPFADFGTVTFTDAYATGSSGTVTPSGATIIDIKQGNEVLTNCATSGSDLTCSYTG

SEQ ID NO: 575 - protein, 256 aa, Aspergillus oryzae
MKLFAILSSTVLASVALASPLTLERRARNAARLQARVAQRHSNLPFKAGTNEILHLNETTHEEYSSNWAGAVLIGSGLHVRDRDEQYCATAWVGIDGDTCQSAILQTGVDFCIDSSGTTSDAWYEWFPDYSHDFSGISISAGDKVKVTVDASSKTAGTAIVENLTTGKTVSHTFAGQDDNALCETNAEWIMEDFSSFLSLVPFANFGTVTFTDISATSGDSSVGASNATIIDIQQNNKTLTSSSASDTEVTIKYIG

SEQ ID NO: 576 - protein, 288 aa, Neurospora crassa
MKLLSPAISLLGVISQPILAQFTFTSTVEHNGVPVPQAETDLKPFKPGTLGRIRSRTDDDSGPEIGTTTLRRVKRTNPTANSNNWCGSVQSTTSSNQIKLVHGTFQHPTCTQRPGVTQYPQAAAAWIGIDGDSWTSALLQAGTVCKINNSTGIVENEVWWQWVPNGAYTITNIPVFAGDWFDITINTTSSTAATIKIMSNRGYTYSVNAWQGATLARVDADWVVERPYYGSTLAGFAQFTQVWFQNAYATLTSGTSSLGITGAKQYQIPGGCASAEYDNSKLYAAVAA

SEQ ID NO: 577 - protein, 282 aa, Aspergillus niger; identical to SEQ ID NO: 144

SEQ ID NO: 578 - protein, 269 aa, Penicillium chrysogenum
MKFAVAIFSTTLLATSVIASPLASQREAHSEIQRSVQGPRRTTRPRNPGTSEVLYLNQTSQETYSSKWAGAVLIGTGYTSVSGEITVPIPHLPNGANSYTNYCASAWVGIDGDTCSTAILQAGIDFCIQGGFISYNAWYEWYPDYAHNFSNIQILPGDVIKMTVDATSKSSGFVTIENLSTGVSVMHIFPYSLRGDLCEFNAEWIVEDFSVNNALAPFADFGTVVFSNAVASRGGDTYGPLGATIMDIYQDRILTSSSVTRDTVTISYI

SEQ ID NO: 579 - protein, 310 aa, Aspergillus niger
MGGRDVAILSRHFAVTSSQSVNGVVSGMFQHTVTSSPSFTTNQFFKKKFTAAIATAIFASVAVAAPQRGLEARLKARGSSKGSRPLQAVARPASTKNQTNVEYSSNWSGAVLVEPPSAAATYTAVTGTFTVPEPTGNSGGSQAASAWVGIDGDTYGNAILQTGVDFTVTDGEASFDAWYEWYPDYAYDFSGIDISAGDEIVAIVESYTSTTGIAIIENKSTGQKVSKELSSSSSLGGQNAEWIVEDFEENGSLVNLVDFGTVTFTGAVAKAAGGESVGLTDATIIEIEENGQVVTDVTIDSDSEVTITYE

SEQ ID NO: 580 - protein, 264 aa, Aspergillus oryzae
MKFTTAIATAILAGSALAAPERGLAARVKARAAGARGSRPLQTVQKPAGVTNKTNVEYSSNWSGAVLENPPSASATYTAVTGTFTVPEPTGGSGSSSASAWVGIDGDTYSEAILQTGVDFTVTNGQASFDAWYEWLPDYAYDFTGIDISAGDVIVAIVESYSSTSGIAIIENQSTGQKVTKELSSSSPLGGINAEWIVEDYEENGSLVDLVDFGTVTFTGAEAKAAGGQTVGLTDATIIEITQNNKVVTDVTIDSDSEVTITYV

SEQ ID NO: 581 - protein, 279 aa, Aspergillus niger
MKFTNYLLTTATLASSVLAAPAPRTGLEDRLRARSLQRQSHPLAPIPLDTSTKENSRLLEADENTTHVTYSSNWAGAVREQPPPQGTYSAVSATFRVPEPTAQGGSGTQAGSAWVGIDGDTYSNAILQTGVDFYVENGQTYNDAWYEWYPDYAYDFDLDVSTGDTIVAKVEAISPSQGVATIENISTGKKATQTIRAPAATATLAGQNADWIVEDFQSGDSMVDLAGFGEISFWGVQAQGGGSTWGVDDATIVELKQGNEVLTDVEVQSDSAFTVKYTS

SEQ ID NO: 582 - protein, 279 aa, Aspergillus nidulans
MKLSLTSSLLTTTTLLGSALSLPQTSNLVSRIQARSLNRQSHPLTRQDGGHSGSQTGFRMASTAAVAYSNNWAGVVREEAPPGGPYTAVSATFTVPKPTAAPNTAGLQAGSAWVGIDGDTYSGAILQTGVDFYIDNGRVYNDAWFEWFPDYAYDFNLAINTGDVIVAKVEALSPSNGVAIIENKNTGQTATQTISAPKADATLKGVNADWIVEDFQSGDKVVALADFEQVTFTGCEAKAQNGDSLGLDGSTIIELKQNNKVLTEVTVKGNNELTVASKM

SEQ ID NO: 583 - protein, 271 aa, Aspergillus oryzae
MKPTHAYLTAALISGALAAPGSTLAQRMRHRSLDHLTLPLQGEGSATDSEARVAGAAVQYSNNWAGVVREQAPPEGPYTAVSATFTVPSATAVANQNGVQAGSVWVGIDGDTYAGAILQAGVDFYSDPTQQNHAWFEWYPAYATNFPNIEVNAGDTIVSTVRSNSPSEGIAIIENKSTGQTVSQTVTAPEPTATLAGQNAEWIVEDFQSGDTMVVLANFGEVEFSGAQAEAGNAKFGLKGGEVIELKQNNKVLTQTEVTGDQDMTVKFIGA

SEQ ID NO: 584 - protein, 270 aa, Penicillium chrysogenum
MKFTSTTILATAILAGTSFAAPRSGLIDRLQSRGTLPRQSLPDEEKGVLLKEAAAGANAQYSKNWAGVVREQPPPSGTYSAVSATFTVPEPTATNDSGEMQAVSAWVGIDGDTYTKAILQTGIDTYIQDGKKTFDAWYEWYPLSAENFDLALSAGDVIVAKVETYSPSKGAAIIENKSSGQSVTKTLSAPSADATLAGQNAEWIVEDFNTGNSMVPLVNFNRVDFTGAQAEAGGAKYGVNNAAVLDIQQNGDVKAHVEIQSDTEFFVTYQ

SEQ ID NO: 585 - protein, 285 aa, Myceliophthora thermophila
MWSIVRSLSLASLISSACTVTAQLSFVASVKQHGKDVDASGLSFVRIPPLEHRWHASRPRRGQNNRTVERDAVSYSANWCGASQHASDSDGIKSVLGYFTAPDLTLRPGTPAPQFAAAWVGIDGAACNTTLLQAGVTTIVNSDGGQSASAWWEWYPEASYTISGLKVKAGEWMSVNITTKDASSAILVIENADTGTSVTLELNNGPQLCRRDAEWILEDFYESGKQVALANFADLWFVDSGATTVGGKNVGFDGATMVHLRDENGNVLCSPEPYDNSNFVVVSKP

SEQ ID NO: 586 - protein, 293 aa, Aspergillus oryzae
MKFPSSLALTALLTGTALAGPHGQGLRARRFQGPGWLGEIDLDSPSEAQAEQPNAQVTPAPQAKSKAIAHSQAQSEDDYLINENWAGAVQTTAPAASATYSYVAATFTLPSVTPTAASSSQTQAASFWVGIDGATSGDAIWQAGVDIYVQNGKPSFAGWYEWYPANSVNIDLEFNFGDVVFTSVESTSNSEGVAVIENLTTGKNVTVTASAPATATLTGQNAEWILEDLAVDGDGLTFVDFGEATFTGCVAKAGGKEYGLGGSALYAVQDRSSNTVQAVPTIVSDSELKVTYQ

SEQ ID NO: 587 - protein, 307 aa, Myceliophthora thermophila
MKPTVLFTLLASGAYAAATPAIPGYSPRTRGMNPHHHAPLRLLHTFTPISTSGKSFRLLASSTESTKGGAILGLPDNDLSTVRTTIRIPAAKMPTAGPTANNTVGEYAASFWVGIDSATDACGAGGSLRAGVDIFWDGTLGGQQTPFAWYQGPGQADVVGFGGGFPVGEGDLVRLTLEAGPAGGEEIAVVAENFGRNVTRADEGAVPVRKVRKVLPAEAGGQKLCRGEAAWMVEDFPLQGRPEFPTALANFTSVTFNTGITLDDGTEKDLTGAEVLDIQLEAQGGRLTSCEVVDDRNVKCARVVGDN

SEQ ID NO: 588 - protein, 197 aa, Myceliophthora thermophila
MRWPLAALLGSALVARQALAELTFTVEATRNGVPIPASEIRLEPFEPGRTRMGAVAEAPRAQRKTRRSNAQADSANWCGSVNMAPTGTNIQLAHGSFQHPSCSIRPGYTFPQAAASWVGIDGDSYRDALLQAGTVCKIDNSTGVVRHEAWWQWVPSAAFTITSMPGQSNTTGFCIPYSAPFVSLCFFGRTRTCLFLH

SEQ ID NO: 589 - protein, 58 aa, Homo sapiens
MRFRIYKRKVLILTLVVAACGFVLWSSNGRQRKNEALAPPLLDAEPARGAGGRGGDHP

SEQ ID NO: 590 - protein, 51 aa, Trichoderma atraviride
MASTNARYVRYLLIAFFTILVFYFVSNSKYEGVDLNKGTFTAPDSTKTTPK

SEQ ID NO: 591 - protein, 52 aa, Trichoderma reesei
MAIARPVRALGGLAAILWCFFLYQLLRPSSSYNSPGDRYINFERDPNLDPTG

SEQ ID NO: 592 - protein, 33 aa, Trichoderma reesei
MLNPRRALIAAAFILTVFFLISRSHNSESASTS

SEQ ID NO: 593 - protein, 84 aa, Trichoderma reesei
MMPRHHSSGFSNGYPRADTFEISPHRFQPRATLPPHRKRKRTAIRVGIAVVVILVLVLWFGQPRSVASLISLGILSGYDDLKLE

SEQ ID NO: 594 - protein, 55 aa, Trichoderma reesei
MLLPKGGLDWRSARAQIPPTRALWNAVTRTRFILLVGITGLILLLWRGVSTSASE

SEQ ID NO: 595 - DNA, 68 bp, Artificial Sequence
  Primer
gattaagttgggtaacgccagggttttcccagtcacgacggtttaaacatcgtgcttgggctattctg

SEQ ID NO: 596 - DNA, 68 bp, Artificial Sequence
  Primer
gcgctggcaacgagagcagagcagcagtagtcgatgctaggcggccgcggaaagacgccagaaagaaa

SEQ ID NO: 597 - DNA, 68 bp, Artificial Sequence
  primer
gtacacttgtttagaggtaatccttctttctagaaggagagcggccgccgctcgatgtggatgatact

SEQ ID NO: 598 - DNA, 68 bp, Artificial Sequence
  Primer
atctatactgtctgcaccaaaagtacaacaacgcaaaccgggcgcgccggaaagacgccagaaagaaa

SEQ ID NO: 599 - DNA, 20 bp, Artificial Sequence
  Primer
cggtttgcgttgttgtactt

SEQ ID NO: 600 - DNA, 68 bp, Artificial Sequence
  Primer
tggaattgtgagcggataacaatttcacacaggaaacagcgtttaaacacaacccaacgttctctcgt

SEQ ID NO: 601 - DNA, 69 bp, Artificial Sequence
  Primer
gattaagttgggtaacgccagggttttcccagtcacgacggtttaaaccggttgtccatttcatccttc

SEQ ID NO: 602 - DNA, 68 bp, Artificial Sequence
  Primer
gcgctggcaacgagagcagagcagcagtagtcgatgctaggcggccgcggggaagcaagtttcgaagt

SEQ ID NO: 603 - DNA, 66 bp, Artificial Sequence
  Primer
gtacacttgtttagaggtaatccttctttctagaaggagagcggccgcctccacgctcttggccac

SEQ ID NO: 604 - DNA, 68 bp, Artificial Sequence
  Primer
gtcattaagtccatcattccacgtccttcagaccgaattcggcgcgccggggaagcaagtttcgaagt

SEQ ID NO: 605 - DNA, 68 bp, Artificial Sequence
  Primer
atgatgcctttgcagaaatggcttgctcgctgactgatacggcgcgcctatcgcgaaagtagccaata

SEQ ID NO: 606 - DNA, 58 bp, Artificial Sequence
  Primer
agcggataacaatttcacacaggaaacagcgtttaaaccatccttttcctcaccacga

SEQ ID NO: 607 - DNA, 68 bp, Artificial Sequence
  Primer
tgattgtaccccagctgcgattgatgtgtatctttgcatgatttaaattctccttagctctgtacagt

SEQ ID NO: 608 - DNA, 28 bp, Artificial Sequence
  Primer
gcggccgctctccttctagaaagaagga

SEQ ID NO: 609 - DNA, 20 bp, Artificial Sequence
  Primer
gaattcggtctgaaggacgt

SEQ ID NO: 610 - DNA, 60 bp, Artificial Sequence
  Primer
tgatggtgatgaggcggaaaagcagaggttacggcgctgaggctttcgtgaccgggcttc

SEQ ID NO: 611 - DNA, 20 bp, Artificial Sequence
  Primer
gtatcagtcagcgagcaagc

SEQ ID NO: 612 - DNA, 18 bp, Artificial Sequence
  Primer
ggaatcgtcaccaaggag

SEQ ID NO: 613 - DNA, 19 bp, Artificial Sequence
  Primer
cttctggtgacattccgac

SEQ ID NO: 614 - DNA, 20 bp, Artificial Sequence
  Primer
cctctgcgttgagcaacata

SEQ ID NO: 615 - DNA, 20 bp, Artificial Sequence
  Primer
cgaaagcgtggagtcttctc

SEQ ID NO: 616 - DNA, 19 bp, Artificial Sequence
  Primer
aacaaagccttcacaggcc

SEQ ID NO: 617 - DNA, 20 bp, Artificial Sequence
  Primer
tgaggctccttccaactttt

SEQ ID NO: 618 - DNA, 59 bp, Artificial Sequence
  Primer
ggtaacgccagggttttcccagtcacgacggtttaaaccgacagcacgttgtgtgctcc

SEQ ID NO: 619 - DNA, 68 bp, Artificial Sequence
  Primer
gcgctggcaacgagagcagagcagcagtagtcgatgctaggcggccgctggagacccagcagccagca

SEQ ID NO: 620 - DNA, 68 bp, Artificial Sequence
  Primer
cccgtcaccgagatctgatccgtcaccgggatccacttaagcggccgctcagagggaggctgcccaac

SEQ ID NO: 621 - DNA, 68 bp, Artificial Sequence
  Primer
gagactcgaacaaagacatctttgcgacctcgtccacggcggcgcgcctggagacccagcagccagca

SEQ ID NO: 622 - DNA, 20 bp, Artificial Sequence
  Primer
gccgtggacgaggtcgcaaa

SEQ ID NO: 623 - DNA, 58 bp, Artificial Sequence
  Primer
agcggataacaatttcacacaggaaacagcgtttaaacccctgcgccctcttctgcac

SEQ ID NO: 624 - DNA, 18 bp, Artificial Sequence
  Primer
ggaatcgtcaccaaggag

SEQ ID NO: 625 - DNA, 19 bp, Artificial Sequence
  Primer
cttctggtgacattccgac

SEQ ID NO: 626 - DNA, 20 bp, Artificial Sequence
  Primer
agcagtccacctgctcaaaa

SEQ ID NO: 627 - DNA, 20 bp, Artificial Sequence
  Primer
gattcacaccaatgagtcgg

SEQ ID NO: 628 - DNA, 20 bp, Artificial Sequence
  Primer
ccccgactttgccccgtcac

SEQ ID NO: 629 - DNA, 20 bp, Artificial Sequence
  Primer
tcgtcagagtcgtcgcccgt

SEQ ID NO: 630 - DNA, 20 bp, Artificial Sequence
  Primer
gcgcagctaatgtcctctgt

SEQ ID NO: 631 - DNA, 20 bp, Artificial Sequence
  Primer
ttgttgagccagagtcgaga

SEQ ID NO: 632 - DNA, 57 bp, Artificial Sequence
  Primer
gtaacgccagggttttcccagtcacgacggtttaaacatgagcgtgatcgacaagtg

SEQ ID NO: 633 - DNA, 68 bp, Artificial Sequence
  Primer
gcgctggcaacgagagcagagcagcagtagtcgatgctaggcggccgccctctgaggtcgagatggag

SEQ ID NO: 634 - DNA, 68 bp, Artificial Sequence
  Primer
tgattgtaccccagctgcgattgatgtgtatctttgcatggcggccgcacgactaatatccactgccg

SEQ ID NO: 635 - DNA, 68 bp, Artificial Sequence
  Primer
aaccaaagtgtacaatgctcatctcgtattcacatgcaaaggcgcgcccctctgaggtcgagatggag

SEQ ID NO: 636 - DNA, 22 bp, Artificial Sequence
  Primer
tttgcatgtgaatacgagatga

SEQ ID NO: 637 - DNA, 57 bp, Artificial Sequence
  Primer
gcggataacaatttcacacaggaaacagcgtttaaactgctcgatcctactccaagg

SEQ ID NO: 638 - DNA, 18 bp, Artificial Sequence
  Primer
ctgtaaaggcagcatcgg

SEQ ID NO: 639 - DNA, 20 bp, Artificial Sequence
  Primer
tcagaacggcttcaatcatt

SEQ ID NO: 640 - DNA, 18 bp, Artificial Sequence
  Primer
ctgtaaaggcagcatcgg

SEQ ID NO: 641 - DNA, 20 bp, Artificial Sequence
  Primer
ttacgactcgatccctgtcc

SEQ ID NO: 642 - DNA, 20 bp, Artificial Sequence
  Primer
gccgctaggatcgtgataag

SEQ ID NO: 643 - DNA, 20 bp, Artificial Sequence
  Primer
gtgtcccaggacgacaactt

SEQ ID NO: 644 - DNA, 20 bp, Artificial Sequence
  Primer
tgaaggttgcagtgatctcg

SEQ ID NO: 645 - DNA, 57 bp, Artificial Sequence
  Primer
gtaacgccagggttttcccagtcacgacggtttaaaccgcattacgaatgcacaaag

SEQ ID NO: 646 - DNA, 68 bp, Artificial Sequence
  Primer
gcgctggcaacgagagcagagcagcagtagtcgatgctaggcggccgcccatgtcagctcagaccaat

SEQ ID NO: 647 - DNA, 68 bp, Artificial Sequence
  Primer
gtacacttgtttagaggtaatccttctttctagaaggagagcggccgcaggccctggactgctagttt

SEQ ID NO: 648 - DNA, 68 bp, Artificial Sequence
  Primer
cgagccatccgccgcggccctatattccacccgagtcctcggcgcgccccatgtcagctcagaccaat

SEQ ID NO: 649 - DNA, 22 bp, Artificial Sequence
  Primer
gaggactcgggtggaatatagg

SEQ ID NO: 650 - DNA, 59 bp, Artificial Sequence
  Primer
gcggataacaatttcacacaggaaacagcgtttaaacttggtcttgaatgaaaggtgtg

SEQ ID NO: 651 - DNA, 57 bp, Artificial Sequence
  Primer
gtaacgccagggttttcccagtcacgacggtttaaacaggtttgggttgtgagatcg

SEQ ID NO: 652 - DNA, 68 bp, Artificial Sequence
  Primer
gcgctggcaacgagagcagagcagcagtagtcgatgctaggcggccgcgcgcaaagctactgggctat

SEQ ID NO: 653 - DNA, 68 bp, Artificial Sequence
  Primer
tgattgtaccccagctgcgattgatgtgtatctttgcatggcggccgctctgctctgctctgttctgc

SEQ ID NO: 654 - DNA, 68 bp, Artificial Sequence
  Primer
aaagttcgtcaaagagcactcatagggctgagaaaagccaggcgcgccgcgcaaagctactgggctat

SEQ ID NO: 655 - DNA, 20 bp, Artificial Sequence
  Primer
tggcttttctcagccctatg

SEQ ID NO: 656 - DNA, 57 bp, Artificial Sequence
  Primer
gcggataacaatttcacacaggaaacagcgtttaaaccaatgtgtgcctgtttttcg

SEQ ID NO: 657 - DNA, 57 bp, Artificial Sequence; identical to SEQ ID NO: 651
  Primer

SEQ ID NO: 658 - DNA, 68 bp, Artificial Sequence; identical to SEQ ID NO: 652
  Primer

SEQ ID NO: 659 - DNA, 68 bp, Artificial Sequence
  Primer
caaccagccgcagcctcagcctctctcagcctcatcagccgcggccgctggcttttctcagccctatg

SEQ ID NO: 660 - DNA, 57 bp, Artificial Sequence; identical to SEQ ID NO: 656
  Primer

SEQ ID NO: 661 - DNA, 20 bp, Artificial Sequence
  Primer
tttatccgcttccacgacac

SEQ ID NO: 662 - DNA, 20 bp, Artificial Sequence
  Primer
tcttgagcacgacaatcgac

SEQ ID NO: 663 - DNA, 20 bp, Artificial Sequence
  Primer
gcatggttgcctagtgaatg

SEQ ID NO: 664 - DNA, 20 bp, Artificial Sequence
  Primer
cgatggtgaagtcaatgtgg

SEQ ID NO: 665 - DNA, 20 bp, Artificial Sequence
  Primer
ggcgattacttccaggacaa

SEQ ID NO: 666 - DNA, 20 bp, Artificial Sequence
  Primer
caatggcaatctggttgttg

SEQ ID NO: 667 - DNA, 57 bp, Artificial Sequence; identical to SEQ ID NO: 632
  Primer

SEQ ID NO: 668 - DNA, 68 bp, Artificial Sequence; identical to SEQ ID NO: 633
  Primer

SEQ ID NO: 669 - DNA, 70 bp, Artificial Sequence
  Primer
caaccagccgcagcctcagcctctctcagcctcatcagccgcggccgctttgcatgtgaatacgagatga

SEQ ID NO: 670 - DNA, 57 bp, Artificial Sequence; identical to SEQ ID NO: 637
  Primer

SEQ ID NO: 671 - DNA, 20 bp, Artificial Sequence
  Primer
ttacgactcgatccctgtcc

SEQ ID NO: 672 - DNA, 20 bp, Artificial Sequence
  Primer
tcttgagcacgacaatcgac

SEQ ID NO: 673 - DNA, 20 bp, Artificial Sequence
  Primer
gcatggttgcctagtgaatg

SEQ ID NO: 674 - DNA, 20 bp, Artificial Sequence
  Primer
gccgctaggatcgtgataag

SEQ ID NO: 675 - DNA, 20 bp, Artificial Sequence
  Primer
gtgtcccaggacgacaactt

SEQ ID NO: 676 - DNA, 20 bp, Artificial Sequence
  Primer
tgaaggttgcagtgatctcg

SEQ ID NO: 677 - DNA, 20 bp, Artificial Sequence
  Primer
ttggtttgaacagctgcaag

SEQ ID NO: 678 - DNA, 20 bp, Artificial Sequence
  Primer
tcttgagcacgacaatcgac

SEQ ID NO: 679 - DNA, 20 bp, Artificial Sequence
  Primer
gcatggttgcctagtgaatg

SEQ ID NO: 680 - DNA, 20 bp, Artificial Sequence
  Primer
atggtcagccagaacctgac

SEQ ID NO: 681 - DNA, 20 bp, Artificial Sequence
  Primer
tcttgagccgtttctcgaat

SEQ ID NO: 682 - DNA, 20 bp, Artificial Sequence
  Primer
ccgctcttagatcgatggtc

SEQ ID NO: 683 - DNA, 60 bp, Artificial Sequence
  Primer
tctccactcgacctgcaggcatgcgcgatcgcgcggccgaattcggtctgaaggacgtgg

SEQ ID NO: 684 - DNA, 61 bp, Artificial Sequence
  Primer
tggcgccccacagcacaagccctgcagactgcttcttcagcatgttgagagaagttgttgg

SEQ ID NO: 685 - DNA, 62 bp, Artificial Sequence
  Primer
catctccactcgacctgcaggcatgcgcgatcgcgcggccgaattcggtctgaaggacgtgg

SEQ ID NO: 686 - DNA, 60 bp, Artificial Sequence
  Primer
ggggatgccctgtcgagccagcgggggagggtgcccaccgccgcccctcccgcccagccg

SEQ ID NO: 687 - DNA, 73 bp, Artificial Sequence
  Primer
gaaggtggtttttgcctgtataagccagccatccggcatactgcccgcggccgccctgcagtgcaggatctgc

SEQ ID NO: 688 - DNA, 64 bp, Artificial Sequence
  Primer
tggcgcccccaccgacgtgggagggctatgatcccagctggaattagcatatgattaattaagg

SEQ ID NO: 689 - DNA, 62 bp, Artificial Sequence
  Primer
ggtttttgcctgtataagccagccatccggcatactgcccgcggccgcagtgcaggatctgc

SEQ ID NO: 690 - DNA, 20 bp, Artificial Sequence
  Primer
gatgttgcgcctgggttgac

SEQ ID NO: 691 - DNA, 19 bp, Artificial Sequence
  Primer
cttcttattgatttgagcc

SEQ ID NO: 692 - DNA, 20 bp, Artificial Sequence
  Primer
gattgtcatggtgtacgtga

SEQ ID NO: 693 - DNA, 16 bp, Artificial Sequence
  Primer
gagccgcatcgcatag

SEQ ID NO: 694 - DNA, 20 bp, Artificial Sequence
  Primer
gcgtcactcatcaaaactgc

SEQ ID NO: 695 - DNA, 19 bp, Artificial Sequence
  Primer
cttcggcttcgatgtttca

SEQ ID NO: 696 - DNA, 26 bp, Artificial Sequence
  Primer
atggcgtcaacaaatgcgcgctatgt

SEQ ID NO: 697 - DNA, 75 bp, Artificial Sequence
  Primer
attcacactctcagaataaattcatcgccaatttgacaggccggccattctcacggtgaatgtaggccttttgta

SEQ ID NO: 698 - DNA, 75 bp, Artificial Sequence
  Primer
ttagtagatagcgcacatagcgcgcatttgttgacgccatgcggttgactattgggtttctgtgcctcaaaagat

SEQ ID NO: 699 - DNA, 71 bp, Artificial Sequence
  Primer
cacactctcagaataaattcatcgccaatttgacaggccggccgcccttgtatctctacacacaggctcaa

SEQ ID NO: 700 - DNA, 25 bp, Artificial Sequence
  Primer
ctgcagtgcaggatctgcatatatg

SEQ ID NO: 701 - DNA, 70 bp, Artificial Sequence
  Primer
ttattcacactctcagaataaattcatcgccaatttgacaggccggccactagtggtctgaaggacgtgg

SEQ ID NO: 702 - DNA, 63 bp, Artificial Sequence
  Primer
ttagtagatagcgcacatagcgcgcatttgttgacgccatctgatgtctgctcaagcggggta

SEQ ID NO: 703 - DNA, 71 bp, Artificial Sequence
  Primer
aggaccttaattaatcatatatgcagatcctgcactgcaggcggccgccactctgagctgaatgcagaagc

SEQ ID NO: 704 - DNA, 71 bp, Artificial Sequence
  Primer
cttgacctcggagaaagttaccctccttttgtcagacacgatcgatttccaacagatggaaagaagaaagg

SEQ ID NO: 705 - DNA, 61 bp, Artificial Sequence
  Primer
aataccgccgcactggccgtagtgagactgggtaggtcgactaattccagctgggatcata

SEQ ID NO: 706 - DNA, 62 bp, Artificial Sequence
  Primer
cacactctcagaataaattcatcgccaatttgacaggccggccaattctcacggtgaatgta

SEQ ID NO: 707 - DNA, 58 bp, Artificial Sequence
  Primer
ttagtagatagcgcacatagcgcgcatttgttgacgccatgcggttgactattgggtt

SEQ ID NO: 708 - DNA, 24 bp, Artificial Sequence
  Primer
ttcgagggccgggagcgatgccga

SEQ ID NO: 709 - DNA, 59 bp, Artificial Sequence
  Primer
ggcttcaacgacctcgtcggcatcgctcccggccctcgaaacgcgcccagcacctggca

SEQ ID NO: 710 - DNA, 60 bp, Artificial Sequence
  Primer
ataccgccgcactggccgtagtgagactgggtaggtcgactaattccagctaggatcata

SEQ ID NO: 711 - DNA, 69 bp, Artificial Sequence
  Primer
agaataccggattactgatccggagaatactttgtaaatagcggccgcggctgatgaggctgagagagg

SEQ ID NO: 712 - DNA, 58 bp, Artificial Sequence
  Primer
caacgacctcgtcggcatcgctcccggccctcgaatgaacggggatgccctgtcgagc

SEQ ID NO: 713 - DNA, 69 bp, Artificial Sequence
  Primer
gattaagttgggtaacgccagggttttcccagtcacgacggtttaaactccaaagttcctgtcttctcc

SEQ ID NO: 714 - DNA, 23 bp, Artificial Sequence
  Primer
tgtcaaattggcgatgaatttat

SEQ ID NO: 715 - DNA, 69 bp, Artificial Sequence
  Primer
ttattcacactctcagaataaattcatcgccaatttgacaggccggccgggtaggaattgtcactcaag

SEQ ID NO: 716 - DNA, 69 bp, Artificial Sequence
  Primer
gcaacgagagcagagcagcagtagtcgatgctaggcggccgcggccgctcatcgtcttgacagcaatgc

SEQ ID NO: 717 - DNA, 68 bp, Artificial Sequence
  Primer
accagccgcagcctcagcctctctcagcctcatcagccgcgcggccgccactctgagctgaatgcaga

SEQ ID NO: 718 - DNA, 66 bp, Artificial Sequence
  Primer
cctatgttgtgtggaattgtgagcggataacaatttcacagtttaaacgcgctgcctccacgatgt

SEQ ID NO: 719 - DNA, 78 bp, Artificial Sequence
  Primer
gaccaacttgtccgttgcgaggccaacttgcattgctgtcaagacgatgagcggccgcataacggtgagactagcggc

SEQ ID NO: 720 - DNA, 72 bp, Artificial Sequence
  Primer
atacaaacgttggcgaggcttctgcattcagctcagagtggcggccgcgtgctgcggaatcattatcatctg

SEQ ID NO: 721 - DNA, 70 bp, Artificial Sequence
  Primer
gcagcttgactaacagctaccccgcttgagcagacatcatcttaattaatcagtcagcgctctcgatggc

SEQ ID NO: 722 - DNA, 70 bp, Artificial Sequence
  Primer
ccaataccgccgcactggccgtagtgagactgggtaggtcatttaaatctaattccagctgggatcatag

SEQ ID NO: 723 - DNA, 62 bp, Artificial Sequence
  Primer
gcagcttgactaacagctaccccgcttgagcagacatcatcatgcgcttccgaatctacaag

SEQ ID NO: 724 - DNA, 59 bp, Artificial Sequence
  Primer
gggtgaggctggcggggtcgccatcgagagcgctgactgaggggtgatcccctcccctg

SEQ ID NO: 725 - DNA, 99 bp, Artificial Sequence
  Primer
gcagcttgactaacagctaccccgcttgagcagacatcatcatggcgtcaacaaatgcgcgctatgtgcgctatctactaatcgccttcttcacaatcc

SEQ ID NO: 726 - DNA, 85 bp, Artificial Sequence
  Primer
tactaatcgccttcttcacaatcctcgtcttctactttgtctccaattcaaagtatgagggcgtcgatctcaacaagggcacctt

SEQ ID NO: 727 - DNA, 99 bp, Artificial Sequence
  Primer
gggtgaggctggcggggtcgccatcgagagcgctgactgactttggtgtcgtcttggtcgaatccggagctgtgaaggtgcccttgttgagatcgacgc

SEQ ID NO: 728 - DNA, 20 bp, Artificial Sequence
  Primer
gcagcttgactaacagctac

SEQ ID NO: 729 - DNA, 19 bp, Artificial Sequence
  Primer
gggtgaggctggcggggtc

SEQ ID NO: 730 - DNA, 61 bp, Artificial Sequence
  Primer
gcagcttgactaacagctaccccgcttgagcagacatcatcatggccattgcccggccggt

SEQ ID NO: 731 - DNA, 64 bp, Artificial Sequence
  Primer
gggtgaggctggcggggtcgccatcgagagcgctgactgagcccgtggctatcaagaagaagac

SEQ ID NO: 732 - DNA, 60 bp, Artificial Sequence
  Primer
gcagcttgactaacagctaccccgcttgagcagacatcatcatgttgaatccacgccgcg

SEQ ID NO: 733 - DNA, 59 bp, Artificial Sequence
  Primer
gggtgaggctggcggggtcgccatcgagagcgctgactgaggacgtcgaggccgattcg

SEQ ID NO: 734 - DNA, 61 bp, Artificial Sequence
  Primer
gcagcttgactaacagctaccccgcttgagcagacatcatcatgatgccacggcatcactc

SEQ ID NO: 735 - DNA, 60 bp, Artificial Sequence
  Primer
gggtgaggctggcggggtcgccatcgagagcgctgactgattcgagcttcaggtcatcgt

SEQ ID NO: 736 - DNA, 60 bp, Artificial Sequence
  Primer
gcagcttgactaacagctaccccgcttgagcagacatcatcatgctgctccccaagggcg

SEQ ID NO: 737 - DNA, 61 bp, Artificial Sequence
  Primer
gggtgaggctggcggggtcgccatcgagagcgctgactgactcagatgccgaagtggacac

SEQ ID NO: 738 - DNA, 116 bp, Artificial Sequence
  Primer
cttgagcagttaattaatttgaatggccggccgcacactttcaagattggcttcaagagagccaatcttgaaagtgtgcttgcgatcgcggatccacttaacgttactgaaatcat

SEQ ID NO: 739 - DNA, 116 bp, Artificial Sequence
  Primer
atgatttcagtaacgttaagtggatccgcgatcgcaagcacactttcaagattggctctcttgaagccaatcttgaaagtgtgcggccggccattcaaattaattaactgctcaag

SEQ ID NO: 740 - DNA, 116 bp, Artificial Sequence
  Primer
cttgagcagttaattaatttgaatggccggccgtacggtgttgccaagaagttcaagagacttcttggcaacaccgtacttgcgatcgcggatccacttaacgttactgaaatcat

SEQ ID NO: 741 - DNA, 116 bp, Artificial Sequence
  Primer
atgatttcagtaacgttaagtggatccgcgatcgcaagtacggtgttgccaagaagtctcttgaacttcttggcaacaccgtacggccggccattcaaattaattaactgctcaag

SEQ ID NO: 742 - DNA, 67 bp, Artificial Sequence
  Primer
ccgcttgagcagttaattaatttaaatggccggcctatatggcgcgccgtaagttttgcacagccgc

SEQ ID NO: 743 - DNA, 67 bp, Artificial Sequence
  Primer
gtcaagctgtttgatgatttcagtaacgttaagtggatccgcgatcgccgtactcgacgcccttgac

SEQ ID NO: 744 - DNA, 20 bp, Artificial Sequence
  Primer
ccttattcctttgaaccttt

SEQ ID NO: 745 - DNA, 20 bp, Artificial Sequence
  Primer
gcaacgtgctcaggagttgc

SEQ ID NO: 746 - DNA, 19 bp, Artificial Sequence
  Primer
gcacactttcaagattggc

SEQ ID NO: 747 - DNA, 19 bp, Artificial Sequence
  Primer
gtacggtgttgccaagaag

SEQ ID NO: 748 - DNA, 448 bp, Artificial Sequence
  Primer
gttgagtacatcgagcgcgacagcattgtgcacaccatgcttcccctcgagtccaaggacagcatcatcgttgaggactcgtgcaacggcgagacggagaagcaggctccctggggtcttgcccgtatctctcaccgagagacgctcaactttggctccttcaacaagtacctctacaccgctgatggtggtgagggtgttgatgcctatgtcattgacaccggcaccaacatcgagcacgtcgactttgagggtcgtgccaagtggggcaagaccatccctgccggcgatgaggacgaggacggcaacggccacggcactcactgctctggtaccgttgctggtaagaagtacggtgttgccaagaaggcccacgtctacgccgtcaaggtgctccgatccaacggatccggcaccatgtctgacgtcgtcaagggcgtcgagtacg

SEQ ID NO: 749 - DNA, 20 bp, Artificial Sequence
  Primer
tcttgagcacgacaatcgac

SEQ ID NO: 750 - DNA, 56 bp, Artificial Sequence
  Primer
gtaacgccagggttttcccagtcacgacggtttaaactcccatagcctcttgaagg

SEQ ID NO: 751 - DNA, 68 bp, Artificial Sequence
  Primer
caaccagccgcagcctcagcctctctcagcctcatcagccgcggccgctgggtgataagcttgggttt

SEQ ID NO: 752 - DNA, 57 bp, Artificial Sequence
  Primer
gcggataacaatttcacacaggaaacagcgtttaaacatcatgatgacccatcgaca

SEQ ID NO: 753 - protein, 407 aa, Artificial Sequence
  Synthetic
SVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPPTWEGYDPSWN

We claim:

1. A *Trichoderma* or *Myceliophthora* cell comprising at least three endogenous proteases having reduced or eliminated activity, wherein:
   a) nucleic acids encoding the proteases are modified to reduce or eliminate expression of the proteases and further comprising a recombinant polynucleotide encoding a mammalian antibody;
   b) at least two of the proteases having reduced or eliminated activity are selected from the group consisting of subtilisin proteases; and
   c) at least one of the proteases having reduced or eliminated activity is selected from the group of glutamic proteases consisting of:
      (i) a gap1 protease of SEQ ID NO: 118 (*Trichoderma*), SEQ ID NO: 574 (*Myceliophthora*) or SEQ ID NO: 587 (*Myceliophthora*), and
      (ii) a gap2 protease of SEQ ID NO: 129 (*Trichoderma*), SEQ ID NO: 585 (*Myceliophthora*) or SEQ ID NO: 588 (*Myceliophthora*).

2. The *Trichoderma* or *Myceliophthora* cell of claim 1, wherein the *Trichoderma* subtilisin proteases are slp2 as set forth in SEQ ID NO: 98 and/or slp3 as set forth in SEQ ID NO: 166; and the *Myceliophthora* subtilisin proteases are slp3 as set forth in SEQ ID NO: 546 and/or slp2 as set forth in SEQ ID NO: 540.

3. The *Trichoderma* or *Myceliophthora* cell of claim 1 comprising at least four, five, six, seven or eight endogenous proteases having reduced or eliminated activity.

4. The *Trichoderma* or *Myceliophthora* cell of claim 3 wherein the proteases are selected from the group consisting of aspartic proteases, trypsin-like serine proteases, subtilisin proteases, and sedolisin proteases.

5. The *Trichoderma* or *Myceliophthora* cell of claim 4, wherein an aspartic protease is *Trichoderma* pep4 as set forth in SEQ ID NO: 37 or *Myceliophthora* pep4 as set forth in SEQ ID NO: 499.

6. The *Trichoderma* or *Myceliophthora* cell of claim 1, wherein at least one of the nucleic acids is a gene comprising a mutation within the coding sequence of the gene that reduces or eliminates the protease activity.

7. The *Trichoderma* or *Myceliophthora* cell of claim 1, wherein the antibody is non-glycosylated or glycosylated.

8. The *Trichoderma* or *Myceliophthora* cell of claim 1, wherein the gene encoding dolichyl-P-Man:Man(5)GlcNAc(2)-PP-dolichyl mannosyltransferase (ALG3) is deleted.

9. The *Trichoderma* or *Myceliophthora* cell of claim 1, wherein the *Trichoderma* or *Myceliophthora* cell further comprises a polynucleotide encoding an α-1,2-mannosidase.

10. The *Trichoderma* or *Myceliophthora* cell of claim 1, further comprising polynucleotide encoding an N-acetylglucosaminyltransferase I catalytic domain.

11. The *Trichoderma* or *Myceliophthora* cell of claim 1, further comprising polynucleotide encoding an N-acetylglucosaminyltransferase II catalytic domain.

12. The *Trichoderma* or *Myceliophthora* cell of claim 1, further comprising a polynucleotide encoding a mannosidase II and/or a galactosyl transferase.

13. A method of making a mammalian antibody, comprising
   a) providing the *Trichoderma* or *Myceliophthora* cell of claim 1,
   b) culturing the *Trichoderma* or *Myceliophthora* cell such that the antibody is expressed, and
   c) purifying the antibody.

14. A method of improving the extracellular stability of an antibody, comprising
   a) providing the *Trichoderma* or *Myceliophthora* cell of claim 1, and
   b) culturing the *Trichoderma* or *Myceliophthora* cell such that the antibody is expressed,
   wherein the antibody exhibits increased extracellular stability compared to the antibody when produced in a corresponding parental *Trichoderma* or *Myceliophthora* cell in which the nucleic acids encoding the proteases are not modified to reduce or eliminate expression of the proteases.

15. The method of claim 14 further comprising purifying the antibody.

* * * * *